United States Patent
Khalil et al.

(10) Patent No.: US 11,530,246 B2
(45) Date of Patent: Dec. 20, 2022

(54) REGULATED SYNTHETIC GENE EXPRESSION SYSTEMS

(71) Applicant: TRUSTEES OF BOSTON UNIVERSITY, Boston, MA (US)

(72) Inventors: Ahmad S. Khalil, Lexington, MA (US); Wilson Wai Chun Wong, Brookline, MA (US); Divya Israni, Boston, MA (US); Huishan Li, Brookline, MA (US)

(73) Assignee: TRUSTEES OF BOSTON UNIVERSITY, Boston, MA (US)

( * ) Notice: Subject to any disclaimer, the term of this patent is extended or adjusted under 35 U.S.C. 154(b) by 0 days.

(21) Appl. No.: 16/875,591

(22) Filed: May 15, 2020

(65) Prior Publication Data
US 2020/0377564 A1 Dec. 3, 2020

Related U.S. Application Data

(60) Provisional application No. 62/848,850, filed on May 16, 2019.

(51) Int. Cl.
C07K 14/47 (2006.01)
(52) U.S. Cl.
CPC ...... *C07K 14/4702* (2013.01); *C07K 2319/09* (2013.01); *C07K 2319/20* (2013.01); *C07K 2319/50* (2013.01); *C07K 2319/715* (2013.01); *C07K 2319/81* (2013.01)
(58) Field of Classification Search
None
See application file for complete search history.

(56) References Cited

U.S. PATENT DOCUMENTS

| | | |
|---|---|---|
| 7,112,715 B2 | 9/2006 | Chambon et al. |
| 8,173,792 B2 | 5/2012 | Wandless et al. |
| 8,735,096 B2 | 5/2014 | Zhou et al. |
| 10,137,180 B2 | 11/2018 | Wandless et al. |
| 10,138,493 B2 | 11/2018 | Khalil et al. |
| 10,550,379 B2 | 2/2020 | Lin et al. |
| 10,590,182 B2 | 3/2020 | Lim et al. |
| 2012/0178647 A1 | 7/2012 | Joung et al. |
| 2014/0234851 A1 | 8/2014 | Leonard et al. |
| 2016/0046682 A1 | 2/2016 | Neutzner et al. |
| 2016/0355797 A1 | 12/2016 | Konermann et al. |
| 2017/0183654 A1 | 6/2017 | Wong et al. |
| 2018/0057838 A1 | 3/2018 | Khalil et al. |
| 2018/0163195 A1 | 6/2018 | Wong et al. |
| 2018/0179522 A1 | 6/2018 | Buckley et al. |
| 2020/0002710 A1 | 1/2020 | Khalil et al. |

FOREIGN PATENT DOCUMENTS

WO 2019/023164 A1 1/2019

OTHER PUBLICATIONS

Beerli et al., Engineering polydactyl zinc-finger transcription factors. Nat Biotechnol. Feb. 2002;20(2):135-41.
Banaszynski et al. Characterization of the FKBP•Rapamycin•FRB Ternary Complex, J Am Chem Soc. Apr. 6, 2005;127(13):4715-21.
Schwarz et al., Rewiring human cellular input-output using modular extracellular sensors, Nat Chem Biol. Feb. 2017;13(2):202-209.
Xie et al., β-cell-mimetic designer cells provide closed-loop glycemic control, Science. Dec. 9, 2016;354(6317):1296-1301.
Xie et al., Designing cell function: assembly of synthetic gene circuits for cell biology applications. Nat Rev Mol Cell Biol. Aug. 2018;19(8):507-525.
Rajakuberan et al., Protocol for a Mammalian Cell-Based Assay for Monitoring the HIV-1 Protease Activity, Methods Mol Biol. 2012;903:393-405.
Weinberg et al., A single-layer platform for Boolean logic and arithmetic through DNA excision in mammalian cells, Nat Biotechnol. May 2017; 35(5): 453-462.
Wu et al., . Remote control of therapeutic T cells through a small molecule-gated chimeric receptor, Science. Oct. 16, 2015;350(6258):aab4077.
Yeo et al., An enhanced CRISPR repressor for targeted mammalian gene regulation, Nature Methods vol. 15, pp. 611-616(2018).
Franco et al., Production and characterization of a genetically engineered anti-caffeine camelid antibody and its use in immunoaffinity chromatography, Journal of Chromatography B, vol. 878, Issue 2, Jan. 15, 2010, pp. 177-186.
Banaszynski et al., A Rapid, Reversible, and Tunable Method to Regulate Protein Function in Living Cells Using Synthetic Small Molecules, Cell. Sep. 8, 2006; 126(5): 995-1004.
Beerli et al., Chemically regulated zinc finger transcription factors J Biol Chem. Oct. 20, 2000;275(42):32617-27.
Bintu et al., Dynamics of epigenetic regulation at the single-cell level, Science. Feb. 12, 2016; 351(6274): 720-724.
Bojar et al., Caffeine-inducible gene switches controlling experimental diabetes, Nature Communications vol. 9, Article No. 2318 (2018).
Chang et al., Rewiring T-cell responses to soluble factors with chimeric antigen receptors. Nat Chem Biol. Mar. 2018;14(3):317-324.
Chavez et al., Highly-efficient Cas9-mediated transcriptional programming, Nat Methods. Apr. 2015, 12(4): 326-328.
Cho et al., Universal Chimeric Antigen Receptors for Multiplexed and Logical Control of T Cell Responses, Cell. May 31, 2018;173(6):1426-1438.e11.
Chung et al., Tunable and reversible drug control of protein production via a self-excising degron, Nat Chem Biol. Sep. 2015; 11(9): 713-720.

(Continued)

*Primary Examiner* — Michael D Burkhart
(74) *Attorney, Agent, or Firm* — Nixon Peabody LLP; Ronald I. Eisenstein; Susanna C. Benn

(57) ABSTRACT

The technology described herein is directed to regulated synthetic gene expression systems. In one aspect described herein are synthetic transcription factors (synTFs) comprising a DNA binding domain, a transcriptional effector domain, and a regulator protein. In other aspects described herein are gene expression systems comprising said synTFs and methods of treating diseases and disorders using said synTFs.

21 Claims, 43 Drawing Sheets

Specification includes a Sequence Listing.

(56) References Cited

OTHER PUBLICATIONS

Daniel et al., Conditional control of fluorescent protein degradation by an auxin-dependent nanobody, Nat Commun. Aug. 17, 2018;9(1):3297.
Daringer et al., Modular Extracellular Sensor Architecture for Engineering Mammalian Cell-based Devices, ACS Synth. Biol. 2014, 3, 12, 892-902.
Deans et al., A tunable genetic switch based on RNAi and repressor proteins for regulating gene expression in mammalian cells. Cell. Jul. 27, 2007;130(2):363-72.
Dunbar et al., Gene therapy comes of age, Science. Jan. 12, 2018;359(6372).
Ede et al., Quantitative Analyses of Core Promoters Enable Precise Engineering of Regulated Gene Expression in Mammalian Cells, ACS Synth Biol. May 20, 2016, 5(5): 395-404.
Feil et al., ., Regulation of Cre Recombinase Activity by Mutated Estrogen Receptor Ligand-Binding Domains, Biochemical and Biophysical Research Communications, vol. 237, Issue 3, Aug. 28, 1997, pp. 752-757.
Felker et al., In Vivo Performance and Properties of Tamoxifen Metabolites for CreERT2 Control, PLoS One. Apr. 14, 2016;11(4):e0152989.
Fischbach et al., Cell-Based Therapeutics: The Next Pillar of Medicine, Sci Transl Med. Apr. 3, 2013; 5(179): 179ps7.
Gao et al., Complex transcriptional modulation with orthogonal and inducible dCas9 regulators. Nat Methods. Dec. 2016;13(12):1043-1049.
Gao et al., Programmable protein circuits in living cells, Science Sep. 21, 2018: vol. 361, Issue 6408, pp. 1252-1258.
Hill et al., Human Antibody-Based Chemically Induced Dimerizers for Cell Therapeutic Applications, Nat Chem Biol. Feb. 2018;14(2):112-117.
Hilton et al., Epigenome editing by a CRISPR-Cas9-based acetyltransferase activates genes from promoters and enhancers, Nat Biotechnol. May 2015;33(5):510-7.
Iwamoto et al., A general chemical method to regulate protein stability in the mammalian central nervous system, Chem Biol. Sep. 24, 2010;17(9):981-8.
Israni et al., Synthetic transcription regulation for human cell therapy, Cell Therapies and Bioengineering Conference 2018, Poster, Sep. 20-22, 2018.
Israni et al., Synthetic transcription regulation for immune cell therapy, Immune Engineering Symposium, Koch Institute, Poster, Jan. 29, 2019 and Mar. 21-23, 2019.
Indra et al., Temporally-controlled site-specific mutagenesis in the basal layer of the epidermis: comparison of the recombinase activity of the tamoxifen-inducible Cre-ERT and Cre-ERT2 recombinases, Nucleic Acids Research, vol. 27, Issue 22, Nov. 1, 1999, pp. 4324-4327.
Jacobs et al., StaPLs: versatile genetically encoded modules for engineering drug-inducible proteins, Nat Methods. Jul. 2018; 15(7): 523-526.
Kang et al., COMBINES-CID: An efficient method for de novo engineering of highly specific chemically induced protein dimerization systems, J Am Chem Soc. Jul. 17, 2019; 141(28): 10948-10952.
Kennedy et al., Rapid blue-light-mediated induction of protein interactions in living cells, Nature Methods vol. 7, pp. 973-975(2010).
Khalil et al., A synthetic biology framework for programming eukaryotic transcription functions, Cell. Aug. 3, 2012;150(3):647-58.
Kitada et al., Programming gene and engineered-cell therapies with synthetic biology. Science. Feb. 9, 2018;359(6376).
Lambert et al., The Human Transcription Factors, Cell. Feb. 8, 2018;172(4):650-665.
Liang et al., Engineering the ABA plant stress pathway for regulation of induced proximity. Sci Signal. Mar. 15, 2011;4(164):rs2.
Lim et al., The Principles of Engineering Immune Cells to Treat Cancer. Cell Feb. 9, 2017;168(4):724-740.
Lin et al., A drug-controllable tag for visualizing newly synthesized proteins in cells and whole animals, PNAS Jun. 3, 2008 105 (22) 7744-7749.
Maeder et al., Oligomerized pool engineering (OPEN): an 'open-source' protocol for making customized zinc-finger arrays. Nat Protoc. 2009;4(10):1471-501.
McCauley et al., Hepatitis C virus NS3/4a protease inhibitors, Curr Opin Pharmacol. Oct. 2016;30:84-92.
Miyamoto et al., Rapid and orthogonal logic gating with a gibberellin-induced dimerization system Nature Chemical Biology vol. 8, pp. 465-470(2012).
Morsut et al., Engineering Customized Cell Sensing and Response Behaviors Using Synthetic Notch Receptors, Cell. Feb. 11, 2016;164(4):780-91.
Norman et al., Quantitative Comparison of Constitutive Promoters in Human ES cells, PLoS One. Aug. 26, 2010,5(8): e12413.
Park et al., Engineering Epigenetic Regulation Using Synthetic Read-Write Modules. Cell 176, 227-238 e20, (2019).
Qin et al., Systematic Comparison of Constitutive Promoters and the Doxycycline-Inducible Promoter, PLoS One. 2010, 5(5): e10611.
Roybal et al., Precision Tumor Recognition by T Cells With Combinatorial Antigen-Sensing Circuits, Cell. Feb. 11, 2016;164(4):770-9.
Sajwan et al., Gene activation by dCas9-CBP and the SAM system differ in target preference, Sci Rep. 2019; 9: 18104.
Sander et al., Selection-free zinc-finger-nuclease engineering by context-dependent assembly (CoDA). Nat Methods. Jan. 2011;8(1):67-9.
Schrader et al., Making it easier to regulate protein stability, Chem Biol. Sep. 24, 2010, 17(9): 917-918.
Sheridan et al., Selectable one-step PCR-mediated integration of a degron for rapid depletion of endogenous human proteins, Biotechniques. 2016, 60(2): 69-74.
Somia, Gene therapy: trials and tribulations. Nat Rev Genet. Nov. 2000;1(2):91-9.
Stanton et al., Systematic transfer of prokaryotic sensors and circuits to mammalian cells. ACS Synth Biol. Dec. 19, 2014;3(12):880-91.
Stanton et al., Chemically induced proximity in biology and medicine, Science. Mar. 9, 2018; 359(6380): eaao5902.
Tague et al., Chemogenetic control of gene expression and cell signaling with antiviral drugs, Nat Methods. Jul. 2018;15(7):519-522.
Vora et al., Rational design of a compact CRISPR-Cas9 activator for AAV-mediated delivery, bioRxiv 2018 doi.org/10.1101/298620.
Hossain et al., "Artificial zinc finger DNA binding domains: versatile tools for genome engineering and modulation of gene expression." Journal of cellular biochemistry 116.11 (2015): 2435-2444.

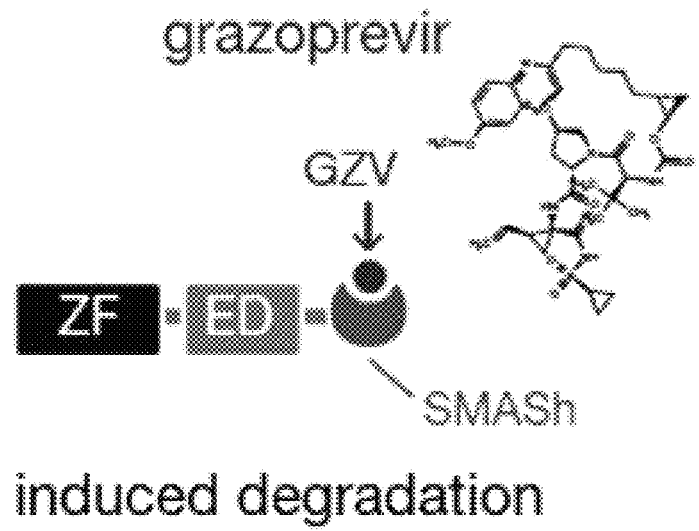
Fig. 6A
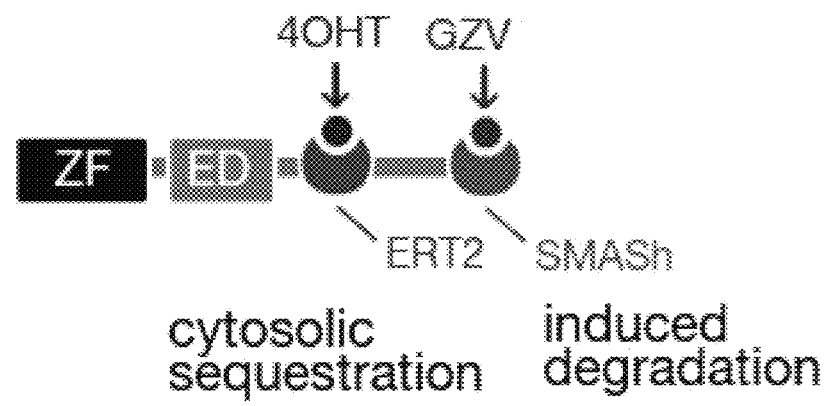
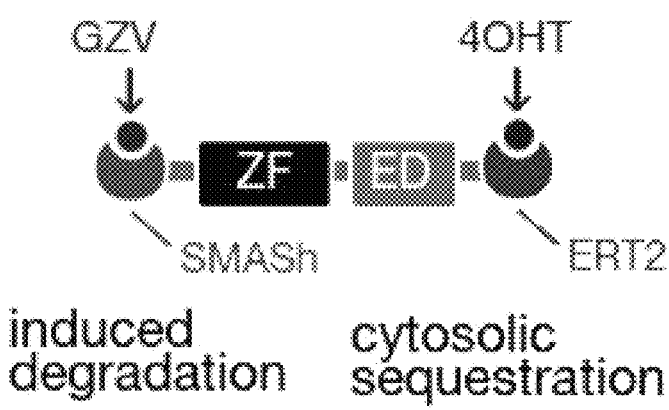
Fig. 6B

MFEPKKKRKVFETSVPLYGFTSICGRRPEMEAA
VSTIPRFLQSSSGSMLDGRFDPQSAAHFFGVYD
GHGGSQVANYCRERMHLALAEEIAKEKPMLCD
GDTWLEKWKKALFNSFLRVDSEIESVAPETVGS
TSVVAVVFPSHIFVANCGDSRAVLCRGKTALPLS
VDHKPDREDEAARIEAAGGKVIQWNGARVFGVL
AMSRSIGDRYLKPSIIPDPEVTAVKRVKEDDCLIL
ASDGVWDVMTDEEACEMARKRILLWHKKNAVA
GDASLLADERRKEGKDPAAMSAAEYLSKLAIQR
GSKDNISVVVVDLKGGSGGSRPGERPFQCRICM
RNFSxxxxxxxHTRTHTGEKPFQCRICMRNFSxxxx
xxxHLRTHTGSQKPFQCRICMRNFSxxxxxxxHLRT
HTGEKPFQCRICMRNFSxxxxxxxHLKTHTGSQKP
FQCRICMRNFSxxxxxxxHLRTHTGEKPFQCRICM
RNFSxxxxxxxHLRTHLRGSPKKKRKVTCRGSGAT
NFSLLKQAGDVEENPGPGHHDEFPTMVFPSGQI
SQASALAPAPPQVLPQAPAPAPAMVSALAQA
PAPVPVLAPGPPQAVAPPAPKPTQAGEGTLSEA
LLQLQEDDEDLGALLGNSTDPAVFTDLASVDNS
EFQQLLNQGIPVAPHTTEPMLMEYPEAITRLVTG
AQRPPDPAPAPLGAPGLPNGLLSGDEDESSIAD
MDFSALLSQISSGGGSGQLTQDEFTQLSQSIAEF
HTYQLGNGRCSSLLAQRIHAPPETVWSVVRRFD
RPQIYKHFIKSCNVSEDFEMRVGCTRDVNVISGL
PANTSRERLDLLDDDRRVTGFSITGGEHRLRNYK
SVTTVHRFEKEEEEERIWTVVLESYVVDVPEGNS
EEDTRLFADTVIRLNLQKLASITEAMN

[ABI]-[ZF]-[2A]-[p65]-[PYL] (SEQ ID NO: 4)

Fig. 19

M*FE*PKKKRKV*EETS*VPLYGFTSICGRRPEM
EAAVSTIPRFLQSSSGSMLDGRFDPQSAAH
FFGVYDGHGGSQVANYCRERMHLALAEEI
AKEKPMLCDGDTWLEKWKKALFNSFLRVD
SEIESVAPETVGSTSVVAVVFPSHIFVANCG
DSRAVLCRGKTALPLSVDHKPDREDEAARI
EAAGGKVIQWNGARVFGVLAMSRSIGDRY
LKPSIIPDPEVTAVKRVKEDDCLILASDGVW
DVMTDEEACEMARKRILLWHKKNAVAGDA
SLLADERRKEGKDPAAMSAAEYLSKLAIQR
GSKDNISVVVDLKGGSGG*SR*PGERPFQC
RICMRNFSxxxxxxxHTRTHTGEKPFQCRICM
RNFSxxxxxxxHLRTHTGSQKPFQCRICMRN
FSxxxxxxxHLRTHTGEKPFQCRICMRNFSxxx
xxxxHLKTHTGSQKPFQCRICMRNFSxxxxxxx
HLRTHTGEKPFQCRICMRNFSxxxxxxxHLRT
HLR*GSTCR*GSGATNFSLLKQAGDVEENPG
P*GHH*PKKKRKV*DAKSLTAWSRTLVTFKDVF*
*VDFTREEWKLLDTAQQILYRNVMLENYKNL*
*VSLGYQLTKPDVILRLEKGEEPWLVEREIHQ*
*ETHPDSETAFEIKSSV*GGGSG*QL*TQDEFTQ
L M*SR*PGERPFQCRICMRNFSxxxxxxxHTRTH
TGEKPFQCRICMRNFSxxxxxxxHLRTHTGS
QKPFQCRICMRNFSxxxxxxxHLRTHTGEKPF
QCRICMRNFSxxxxxxxHLKTHTGSQKPFQC
RICMRNFSxxxxxxxHLRTHTGEKPFQCRICM
RNFSxxxxxxxHLRTHLR*GSTCR*DEFPTMVFP
SGQISQASALAPAPPQVLPQAPAPAPAPAM
VSALAQAPAPVPVLAPGPPQAVAPPAPKPT
QAGEGTLSEALLQLQFDDEDLGALLGNST
DPAVFTDLASVDNSEFQQLLNQGIPVAPHT
TEPMLMEYPEAITRLVTGAQRPPDPAPAPL
GAPGLPNGLLSGDEDFSSIADMDFSALLSQ
ISS*QL*CVRGSSAGDMRAANLWPSPLMIKRS
KKNSLALSLTADQMVSALLDAEPPILYSEYD
PTRPFSEASMMGLLTNLADRELVHMINWAK
RVPGFVDLTLHDQVHLLECAWLEILMIGLV
WRSMEHPVKLLFAPNLLLDRNQGKCVEGM
VEIFDMLLATSSRFRMMNLQGEEFVCLKSII
LLNSGVYTFLSSTLKSLEEKDHIHRVLDKIT
DTLIHLMAKAGLTLQQQHQRLAQLLLILSHI
RHMSNKGMEHLYSMKCKNVVPLYDLLLEA
ADAHRLHAPTSRGGASVEETDQSHLATAG
STSSHSLQKYYITGEAEGFPATA

[ZF]-[p65]-[ERT2] (SEQ ID NO: 6)

Fig. 21

M*DAKSLTAWSRTLVTEKDVFVDFTREEWKL*
*LDTAQQILYRNVMLENYKNLVSLGYQLTKP*
*DVILRLEKGEEPWLVEREIHQETHPDSETAF*
*EIKSSV*LEGGGGSG*TCRSR*PGERPFQCRIC
MRNFSxxxxxxxHTRTHTGEKPFQCRICMRN
FSxxxxxxxHLRTHTGSQKPFQCRICMRNFSx
xxxxxxHLRTHTGEKPFQCRICMRNFSxxxxxx
xHLKTHTGSQKPFQCRICMRNFSxxxxxxxHL
RTHTGEKPFQCRICMRNFSxxxxxxxHLRTHL
R*GSQL*CVRGSSAGDMRAANLWPSPLMIKR
SKKNSLALSLTADQMVSALLDAEPPILYSEY
DPTRPFSEASMMGLLTNLADRELVHMINWA
KRVPGFVDLTLHDQVHLLECAWLEILMIGLV
WRSMEHPVKLLFAPNLLLDRNQGKCVEGM
VEIFDMLLATSSRFRMMNLQGEEFVCLKSII
LLNSGVYTFLSSTLKSLEEKDHIHRVLDKIT
DTLIHLMAKAGLTLQQQHQRLAQLLLILSHI
RHMSNKGMEHLYSMKCKNVVPLYDLLLEA
ADAHRLHAPTSRGGASVEETDQSHLATAG
STSSHSLQKYYITGEAEGFPATA

[KRAB]-[ZF]-[ERT2] (SEQ ID NO: 7)

Fig. 22

MSRPGERPFQCRICMRNFSxxxxxxxHTRTH
TGEKPFQCRICMRNFSxxxxxxxHLRTHTGS
QKPFQCRICMRNFSxxxxxxxHLRTHTGEKPF
QCRICMRNFSxxxxxxxHLKTHTGSQKPFQC
RICMRNFSxxxxxxxHLRTHTGEKPFQCRICM
RNFSxxxxxxxHLRTHLRGSTCRDYKDHDGD
YKDHDIDYKDDDDKMAPKKKRKVGIHGVP
GGLEGGGGSGGTEDVVCCHSIYGKKKGDI
DTYRYIGSSGTGCVVIVGRIVLSGSGTSAPIT
AYAQQTRGLLGCIITSLTGRDKNQVEGEVQI
VSTATQTFLATCINGVCWAVYHGAGTRTIAS
PKGPVIQMYTNVDQDLVGWPAPQGSRSLT
PCTCGSSDLYLVTRHADVIPVRRRGDSRGS
LLSPRPISYLKGSSGGPLLCPAGHAVGLFR
AAVCTRGVAKAVDFIPVENLETTMRSPVFT
DNSSPPAVTLTHPITKIDREVLYQEFDEMEE
CSQHYPYDVPDYAGGGGSGGTDEFPTMVF
PSGQISQASALAPPPQVLPQAPAPAPAPA
MVSALAQAPAPVPVLAPGPPQAVAPPAPK
PTQAGEGTLSEALLQLQFDDEDLGALLGN
STDPAVFTDLASVDNSEFQQLLNQGIPVAP
HTTEPMLMEYPEAITRLVTGAQRPPDPAPA
PLGAPGLPNGLLSGDEDFSSIADMDFSALL
SQISSQL

[ZF]-[NS3]-[p65]  (SEQ ID NO: 8)

Fig. 23

MDAKSLTAWSRTLVTFKDVFVDFTREEWKL
LDTAQQILYRNVMLENYKNLVSLGYQLTKP
DVILRLEKGEEPWLVEREIHQETHPDSETAE
EIKSSVTCRDYKDHDGDYKDHDIDYKDDDD
KMAPKKKRKVGIHGVPGGLEGGGGSGGTE
DVVCCHSIYGKKKGDIDTYRYIGSSGTGCVV
IVGRIVLSGSGTSAPITAYAQQTRGLLGCIITS
LTGRDKNQVEGEVQIVSTATQTFLATCINGV
CWAVYHGAGTRTIASPKGPVIQMYTNVDQD
LVGWPAPQGSRSLTPCTCGSSDLYLVTRHA
DVIPVRRRGDSRGSLLSPRPISYLKGSSGG
PLLCPAGHAVGLFRAAVCTRGVAKAVDFIP
VENLETTMRSPVFTDNSSPPAVTLTHPITKID
REVLYQEFDEMEECSQHYPYDVPDYAGGG
GSGGTSRPGERPFQCRICMRNFSxxxxxxxH
TRTHTGEKPFQCRICMRNFSxxxxxxxHLRTH
TGSQKPFQCRICMRNFSxxxxxxxHLRTHTG
EKPFQCRICMRNFSxxxxxxxHLKTHTGSQK
PFQCRICMRNFSxxxxxxxHLRTHTGEKPFQC
RICMRNFSxxxxxxxHLRTHLRGSQL

[KRAB]-[NS3]-[ZF]  (SEQ ID NO: 9)

Fig. 24

MSRPGERPFQCRICMRNFSxxxxxxxHTRTHTGEKPFQ
CRICMRNFSxxxxxxxHLRTHTGSQKPFQCRICMRNFS
xxxxxxxHLRTHTGEKPFQCRICMRNFSxxxxxxxHLKTH
TGSQKPFQCRICMRNFSxxxxxxxHLRTHTGEKPFQCR
ICMRNFSxxxxxxxHLRTHLR*GSTCRDEFPTMVFPSGQI
SQASALAPAPPQVLPQAPAPAPAPAMVSALAQAPAP
VPVLAPGPPQAVAPPAPKPTQAGEGTLSEALLQLQF
DDEDLGALLGNSTDPAVETDLASVDNSEFQQLLNQGI
PVAPHTTEPMLMEYPEAITRLVTGAQRPPDPAPAPLG
APGLPNGLLSGDEDFSSIADMDFSALLSQISSQL*CVR
GSSAGDMRAANLWPSPLMIKRSKKNSLALSLTADQ
MVSALLDAEPPILYSEYDPTRPFSEASMMGLLTNLAD
RELVHMINWAKRVPGFVDLTLHDQVHLLECAWLEILM
IGLVWRSMEHPVKLLFAPNLLLDRNQGKCVEGMVEI
FDMLLATSSRFRMMNLQGEEFVCLKSIILLNSGVYTF
LSSTLKSLEEKDHIHRVLDKITDTLIHLMAKAGLTLQQ
QHQRLAQLLLILSHIRHMSNKGMEHLYSMKCKNVVP
LYDLLLEAADAHRLHAPTSRGGASVEETDQSHLATA
GSTSSHSLQKYYITGEAEGFPATA*PGDEMEECSQHL
PGAGSSGDIM*DYKDDDDK**GSSGTGSGSGTSAPITAY
AQQTRGLLGCIITSLTGRDKNQVEGEVQIVSTATQTFL
ATCINGVCWAVYHGAGTRTIASPKGPVIQMYTNVDQD
LVGWPAPQGSRSLTPCTCGSSDLYLVTRHADVIPVRR
RGDSRGSLLSPRPISYLKGSSGGPLLCPAGHAVGLFR
AAVCTRGVAKAVDFIPVENLETTMRSPVFTD*NSSPPA
VTLTHPITKIDTKYIMTCMSADLEVVT**STWVLVGGVLA
ALAAYCLSTGCVVIVGRIVLSGKPAIIPDREVLY*

[ZF]-[p65]-[ERT2]-[SMASh]  (SEQ ID NO: 10)

Fig. 25

MDYKDDDDKGSSGTGSGSGTS*APITAYAQQTRGLLG
CIITSLTGRDKNQVEGEVQIVSTATQTFLATCINGVCWA
VYHGAGTRTIASPKGPVIQMYTNVDQDLVGWPAPQG
SRSLTPCTCGSSDLYLVTRHADVIPVRRRGDSRGSLL
SPRPISYLKGSSGGPLLCPAGHAVGLFRAAVCTRGVA
KAVDFIPVENLETTMRSPVFTD*NSSPPAVTLTHPLTKID
TKYIMTCMSADLEVVT*STWVLVGGVLAALAAYCLSTG
CVVIVGRIVLSGKPAGSSGSSIIPDREVLYQEFEDVVP
CSMGSPGSRPGERPFQCRICMRNFSxxxxxxxHTRTHT
GEKPFQCRICMRNFSxxxxxxxHLRTHTGSQKPFQCRI
CMRNFSxxxxxxxHLRTHTGEKPFQCRICMRNFSxxxxx
xxHLKTHTGSQKPFQCRICMRNFSxxxxxxxHLRTHTG
EKPFQCRICMRNFSxxxxxxxHLRTHLR*GSTCRDEFPT
MVFPSGQISQASALAPAPPQVLPQAPAPAPAPAMVS
ALAQAPAPVPVLAPGPPQAVAPPAPKPTQAGEGTLS
EALLQLQFDDEDLGALLGNSTDPAVFTDLASVDNSE
FQQLLNQGIPVAPHTTEPMLMEYPEAITRLVTGAQRP
PDPAPAPLGAPGLPNGLLSGDEDFSSIADMDFSALL
SQISSQL*CVRGSSAGDMRAANLWPSPLMIKRSKKNS
LALSLTADQMVSALLDAEPPILYSEYDPTRPFSEASM
MGLLTNLADRELVHMINWAKRVPGFVDLTLHDQVHL
LECAWLEILMIGLVWRSMEHPVKLLFAPNLLLDRNQ
GKCVEGMVEIFDMLLATSSRFRMMNLQGEEFVCLKS
IILLNSGVYTFLSSTLKSLEEKDHIHRVLDKITDTLIHLM
AKAGLTLQQQHQRLAQLLLILSHIRHMSNKGMEHLY
SMKCKNVVPLYDLLLEAADAHRLHAPTSRGGASVEE
TDQSHLATAGSTSSHSLQKYYITGEAEGFPATA

[SMASh]-[ZF]-[p65]-[ERT2]  (SEQ ID NO: 11)

Fig. 26

M*DYKDHDGDYKDHDIDYKDDDDK*MAPKKK
RKVGIHGVPGGLEGGGGSGGT<u>ASSR</u>PGERP
FQCRICMRNFSxxxxxxxHTRTHTGEKPFQCRI
CMRNFSxxxxxxxHLRTHTGSQKPFQCRICMR
NFSxxxxxxxHLRTHTGEKPFQCRICMRNFSxx
xxxxxHLKTHTGSQKPFQCRICMRNFSxxxxxxx
HLRTHTGEKPFQCRICMRNFSxxxxxxxHLRTH
LR<u>GSTCR</u>*DEFPTMVFPSGQISQASALAPAPP*
*QVLPQAPAPAPAMVSALAQAPAPVPVLAP*
*GPPQAVAPPAPKPTQAGEGTLSEALLQLQF*
*DDEDLGALLGNSTDPAVETDLASVDNSEFQQ*
*LLNQGIPVAPHTTEPMLMEYPEAITRLVTGAQ*
*RPPDPAPAPLGAPGLPNGLLSGDEDFSSIAD*
*MDFSALLSQISS*PGDEMEECSQHLPGAGSS
GDIMDYKDDDDKGSSGTGSGSGTS*APITAYA*
*QQTRGLLGCIITSLTGRDKNQVEGEVQIVSTAT*
*QTFLATCINGVCWAVYHGAGTRTIASPKGPVI*
*QMYTNVDQDLVGWPAPQGSRSLTPCTCGSS*
*DLYLVTRHADVIPVRRRGDSRGSLLSPRPISY*
*LKGSSGGPLLCPAGHAVGLFRAAVCTRGVAK*
*AVDFIPVENLETTMRSPVFTD*NSSPPAVTLTH
PITKIDTKYIMTCMSADLEVVT*STWVLVGGVL*
*AALAAYCLSTGCVVIVGRIVLSGKPAIIPDREVL*
*Y*

[ZF]-[p65]-[SMASh] (SEQ ID NO: 12)

Fig. 27

M*LAVSVTFEDVAVLFTRDEWKKLDLSQRSLYRE*
*VMLENYSNLASMAGFLFTKPKVISLLQQGEDP*
*W*GGSGSGSAC*SR*PGERPFQCRICMRNFSxxxxx
xxHTRTHTGEKPFQCRICMRNFSxxxxxxxHLRTH
TGSQKPFQCRICMRNFSxxxxxxxHLRTHTGEKP
FQCRICMRNFSxxxxxxxHLKTHTGSQKPFQCRIC
MRNFSxxxxxxxHLRTHTGEKPFQCRICMRNFSxx
xxxxxHLRTHLR*GSQL*CVRGSSAGDMRAANLWP
SPLMIKRSKKNSLALSLTADQMVSALLDAEPPIL
YSEYDPTRPFSEASMMGLLTNLADRELVHMIN
WAKRVPGFVDLTLHDQVHLLECAWLEILMIGLV
WRSMEHPVKLLFAPNLLLDRNQGKCVEGMVEI
FDMLLATSSRFRMMNLQGEEFVCLKSIILLNSG
VYTFLSSTLKSLEEKDHIHRVLDKITDTLIHLMAK
AGLTLQQQHQRLAQLLLILSHIRHMSNKGMEHL
YSMKCKNVVPLYDLLLEAADAHRLHAPTSRGG
ASVEETDQSHLATAGSTSSHSLQKYYITGEAEG
FPATA*PGDEMEECSQHLPGAGSSGDIM*DYKDD*
*DDK*GSSSGTGSGSGTS*APITAYAQQTRGLLGCIIT*
*SLTGRDKNQVEGEVQIVSTATQTFLATCINGVCW*
*AVYHGAGTRTIASPKGPVIQMYTNVDQDLVGWP*
*APQGSRSLTPCTCGSSDLYLVTRHADVIPVRRR*
*GDSRGSLLSPRPISYLKGSSGGPLLCPAGHAVG*
*LFRAAVCTRGVAKAVDFIPVENLETTMRSPVFTD*
NSSPPAVTLTHPITKIDTKYIMTCMSADLEVVT*ST*
*WVLVGGVLAALAAYCLSTGCVVIVGRIVLSGKPAI*
*IPDREVLY*

[KRAB]-[ZF]-[ERT2]-[SMASh] (SEQ ID NO: 13)

Fig. 28

M*GKKTKRTADSSSSEDEEEYVVEKVLDRRVVKGQV*
*EYLLKWKGFSEEHNTWEPEKNLDCPELISEFMKKY*
*KKMKEGENNKPREKSESNKRKSNFSNSADDIKSKK*
*KREQSNDIARGFERGLEPEKILGATDSCGDLMFLMK*
*WKDTDEADLVLAKEANVKCPQIVIAFYEERLTWHAY*
*PEDAENKEKETAKS*GGSGSGSAC<u>SR</u>PGERPFQCRI
CMRNFSxxxxxxxHTRTHTGEKPFQCRICMRNFSxxxx
xxxHLRTHTGSQKPFQCRICMRNFSxxxxxxxHLRTHT
GEKPFQCRICMRNFSxxxxxxxHLKTHTGSQKPFQCR
ICMRNFSxxxxxxxHLRTHTGEKPFQCRICMRNFSxxxx
xxxHLRTHLR<u>GSQL</u>CVRGSSAGDMRAANLWPSPLM
IKRSKKNSLALSLTADQMVSALLDAEPPILYSEYDPT
RPFSEASMMGLLTNLADRELVHMINWAKRVPGFVD
LTLHDQVHLLECAWLEILMIGLVWRSMEHPVKLLFA
PNLLLDRNQGKCVEGMVEIFDMLLATSSRFRMMNL
QGEEFVCLKSIILLNSGVYTFLSSTLKSLEEKDHIHR
VLDKITDTLIHLMAKAGLTLQQQHQRLAQLLLILSHI
RHMSNKGMEHLYSMKCKNVVPLYDLLLEAADAHRL
HAPTSRGGASVEETDQSHLATAGSTSSHSLQKYYIT
GEAEGFPATA<u>PGDEMEECSQHLPGAGSSGDIM</u>*DYK*
*DDDDK*GSSGTGSGSGTS*APITAYAQQTRGLLGCIITS*
*LTGRDKNQVEGEVQIVSTATQTFLATCINGVCWAVYH*
*GAGTRTIASPKGPVIQMYTNVDQDLVGWPAPQGSR*
*SLTPCTCGSSDLYLVTRHADVIPVRRRGDSRGSLLSP*
*RPISYLKGSSGGPLLCPAGHAVGLFRAAVCTRGVAK*
*AVDFIPVENLETTMRSPVFTD*NSSPPAVTLTHPITKID
TKYIMTCMSADLEVVT*STWVLVGGVLAALAAYCLST*
*GCVVIVGRIVLSGKPAIIPDREVLY*

[Hp1a]-[ZF]-[ERT2]-[SMASh]   (SEQ ID NO: 14)

Fig. 29

M*SEREVSTAPAGTDMPAAKKQKLSSDENSNPDLSGDEND*
*DAVSIESGTNTERPDTPTNTPNAPGRKSWGKGKWKSKKC*
*KYSEKCVNSLKEDHNQPLEGVQFNWHSKEGDPLVFATVG*
*SNRVTLYECHSQGEIRLLQSYVDADADENFYTCAWTYDSN*
*TSHPLLAVAGSRGIIRIINPITMQCIKHYVGHGNAINELKEHP*
*RDPNLLLSVSKDHALRLWNIQTDTLVAIEGGVEGHRDEVLS*
*ADYDLLGEKIMSCGMDHSLKLWRINSKRMMNAIKESYDYN*
*PNKTNRPFISQKIHFPDFSTRDIHRNYVDCVRWLGDLILSKS*
*CENAIVCWKPGKMEDDIDKIKPSESNVTILGRFDYSQCDIW*
*YMRFSMDFWQKMLALGNQVGKLYVWDLEVEDPHKAKCT*
*TLTHHKCGAAIRQTSFSRDSSILIAVCDDASIWRWDRLR*GG
SGSGSAC<u>SR</u>PGERPFQCRICMRNFSxxxxxxxHTRTHTGEKP
FQCRICMRNFSxxxxxxxHLRTHTGSQKPFQCRICMRNFSxxx
xxxxHLRTHTGEKPFQCRICMRNFSxxxxxxxHLKTHTGSQKP
FQCRICMRNFSxxxxxxxHLRTHTGEKPFQCRICMRNFSxxxx
xxxHLRTHLR<u>GSQL</u>CVRGSSAGDMRAANLWPSPLMIKRSK
KNSLALSLTADQMVSALLDAEPPILYSEYDPTRPFSEASMM
GLLTNLADRELVHMINWAKRVPGFVDLTLHDQVHLLECAW
LEILMIGLVWRSMEHPVKLLFAPNLLLDRNQGKCVEGMVEI
FDMLLATSSRFRMMNLQGEEFVCLKSIILLNSGVYTFLSSTL
KSLEEKDHIHRVLDKITDTLIHLMAKAGLTLQQQHQRLAQL
LLILSHIRHMSNKGMEHLYSMKCKNVVPLYDLLLEAADAHR
LHAPTSRGGASVEETDQSHLATAGSTSSHSLQKYYITGEA
EGFPATA<u>PGDEMEECSQHL</u>PGAGSSGDIMDYKDDDDKGS
SGTGSGSGTS*APITAYAQQTRGLLGCIITSLTGRDKNQVEGE*
*VQIVSTATQTFLATCINGVCWAVYHGAGTRTIASPKGPVIQM*
*YTNVDQDLVGWPAPQGSRSLTPCTCGSSDLYLVTRHADVIP*
*VRRRGDSRGSLLSPRPISYLKGSSGGPLLCPAGHAVGLFRA*
*AVCTRGVAKAVDFIPVENLETTMRSPVFTD*NSSPPAVTLTHP
ITKIDTKYIMTCMSADLEVVT*STWVLVGGVLAALAAYCLSTG*
*CVVIVGRIVLSGKPAIIPDREVLY*

[EED]-[ZF]-[ERT2]-[SMASh] (SEQ ID NO: 15)

Fig. 30

REGULATED SYNTHETIC GENE EXPRESSION SYSTEMS

CROSS-REFERENCE TO RELATED APPLICATIONS

This application claims benefit under 35 U.S.C. § 119(e) of U.S. Provisional Application No. 62/848,850 filed May 16, 2019, the contents of which are incorporated herein by reference in their entirety.

GOVERNMENT SUPPORT

This invention was made with government support under Grant No. D16AP00142 awarded by the Defense Advanced Research Projects Agency and Grant No. CCF-1522074 awarded by the National Science Foundation. The government has certain rights in the invention.

SEQUENCE LISTING

The instant application contains a Sequence Listing which has been submitted in ASCII format via EFS-Web and is hereby incorporated by reference in its entirety. Said ASCII copy, created on May 15, 2020, is named 701586-095350_SL.txt and is 921,581 bytes in size.

TECHNICAL FIELD

The technology described herein relates to regulated synthetic gene expression systems.

BACKGROUND

Next generation cell therapies seek to create designer immune cells that can sense and respond to disease in sophisticated ways. Achieving this goal fundamentally requires engineered regulatory elements and circuitry that can be used to program human cell functions by processing complex environmental inputs and mediating precisely regulated expression of therapeutic agents. Towards this goal, synthetic transcriptional programs can interface with sense and response modules to enable new layers of regulation in cells.

To advance immune cell therapies beyond reliance on simple constitutive expression of therapeutic agents, there is a need for programmable genetic components that offer tunable and versatile regulatory profiles. Moreover, these components must themselves have properties that are compatible with the human therapeutic context, including high specificity, low immunogenicity, and deliverability.

T cell immunotherapy has shown tremendous promise for cancer treatment, including liquid tumors such as leukemia and lymphoma. However, alongside its remarkable effectiveness, there are significant side effects, such as cytokine releasing syndrome (CRS) and neurotoxicity, which pose life-threatening risks to patients receiving immunotherapy. It is increasingly important to develop safe and effective sense-and-response strategies that can control the activity of engineered T cells post-infusion.

SUMMARY OF THE INVENTION

The technology described herein is directed to a method to control gene expression. In general, the technology described herein relates to a synthetic transcription factor (synTF) that comprises a regulator protein (RP), where the regulator protein regulates the activity of the synTF. In particular, the synTFs according to the methods, systems and compositions as disclosed herein comprise (i) a DNA binding domain (DBD) which binds to a target nucleic acid sequence (or target DNA binding motif (DBM)) located 3' of a promoter that is operatively linked to the nucleic acid of a gene of interest (GOI) to be expressed, (ii) an effector domain (ED) and a regulator protein (RP), where the regulator protein controls the coupling of the DNA binding domain (DBD) with the effector domain (ED), or controls the cellular localization of the ED, such that when the ED and DBD are attached and/or located in the nucleus, the ED can function to recruit or repress translation machinery to the promoter to regulate gene expression of a gene of interest. In some embodiments, the ED can be a transcriptional activator (TA), thereby turning on gene expression when the ED is present at the transcription start site of a gene of interest, and in some embodiments, the ED is a transcriptional repressor (TR), such that when the ED is present at the transcription start site of a gene of interest, the gene expression is inhibited or repressed.

In some embodiments of the systems, compositions and methods as disclosed herein, the regulator protein of the SynTF is selected from a protease, a pair of inducible proximity domains (IPDs) or a translocation domain (i.e., a cytosolic sequestering protein), each of which are described herein and in more detail below.

In some embodiments of the systems, compositions and methods as disclosed herein, the synTF comprises a regulator protein that is a self-cleaving protease, for example, one exemplary protease is NS3. SynTFs comprising self-cleaving proteases can also be referred to herein as "repressible proteases SynTF". In such embodiments of the systems, compositions and methods disclosed herein, the DBD is directly linked or indirectly linked (or coupled) to the effector domain, and the protease regulator protein (typically located between the DBD and ED) controls the coupling of the DBD to the ED. In such an embodiment, in the presence of an agent which inhibits the regulator protein (i.e., NS3 protein), the DBD and ED remain coupled or intact (either directly or indirectly) and the effector domain can control gene expression from the promoter (i.e., turning on gene expression of the gene of interest (GOI) if the ED is a TA, or repressing gene expression if the ED is a TR) (see e.g., FIG. 5A-5C). In such an embodiment, in the absence of an agent which inhibits the regulator protein (i.e., NS3 protein), the linkage between the DBD and ED is broken or cleaved, and therefore the ED is not brought into proximity of the transcription start site of the gene (or the ED dissociates from the start site), and therefore the TA can no longer initiate gene expression of the GOI, or alternatively a RP can no longer repress gene expression of the gene of interest.

In another embodiment of the systems, compositions and methods as disclosed herein, the synTF comprises a regulator protein that is a pair of inducer proximity domains (referred to as an "IPD pair") which is located between the DBD and ED, where each domain of the IPD come together in the presence of an inducer agent, and therefore linking the DBD and ED and controlling gene expression (see, e.g., FIGS. 3 and 7A). SynTFs comprising an IPD pair can also be referred to herein as a "heterodimerization domain SynTF". For example, in such embodiments, where the regulator protein is an IPD pair, each domain of the IPD pair is attached to either the DBD or the ED, such that in the presence of an inducer agent, each domain of the IPD bind to the inducer agent, thereby indirectly coupling the DBD with the ED, such that when the DBD binds to a promoter region, the ED can control gene expression from the promoter (i.e., turning on gene expression if the ED is a TA, or repressing gene expression if the ED is a TR) (see e.g., FIG. 7A). In alternative embodiments where the RP is an IPD pair, in the absence of the inducer agent, the DBD and ED remain uncoupled, and therefore the ED is not in a position to regulate gene transcription from the transcription start site at the GOI. Exemplary IPD pairs and their inducing agents are disclosed herein.

In some embodiments of the systems, compositions and methods as disclosed herein, the synTF comprises a regulator protein that is a translocation domain. In some embodiments, a translocation domain is a cytosolic sequestering protein, for example, one exemplary cytosolic sequestering protein is ERT2 and variants thereof. SynTFs comprising a translocation domain, e.g., a cytosolic sequestering protein can also be referred to herein as "Translocation Domain SynTF". In such embodiments of the systems, compositions and methods disclosed herein, the DBD is directly linked or indirectly linked (or coupled) to the effector domain, and the translocation domain, e.g., a cytosolic sequestering protein regulator protein (which can be attached to either to the ED, or DBD or located between the DBD and ED) controls the cellular localization of the synTF comprising the DBD-ED (see, e.g., FIG. 4). In such an embodiment, in the absence of a ligand that binds to the cytosolic sequestering protein, the cytosolic sequestering protein sequesters the ED and coupled DBD in the cytosol, and therefore the ED is not brought into proximity of the transcription start site of the gene (or the ED dissociates from the start site), and therefore the TA can no longer initiate gene expression of the GOI, or alternatively a RP can no longer repress gene expression of the gene of interest. In contrast, in the in the presence of a ligand that binds to the cytosolic sequestering protein, the cytosolic sequestering protein is inhibited, allowing the DBD-ED of the synTF can translocate from the cytosol to the nucleus where the DBD can bind to the DNA binding motif (DBM) and the effector domain (ED) can control gene expression from the promoter (i.e., turning on gene expression of the gene of interest (GOI) if the ED is a TA, or repressing gene expression if the ED is a TR) (see e.g., FIG. 4).

Another aspect of the systems, compositions and methods as disclosed herein are synTFs comprising a small-molecule assisted shutoff (SMASh) domain, which can also be referred to herein as an "induced degradation domain." In general, SMASh domains function to target the polypeptide that is attached to the SMASh domain for degradation. In some embodiments, the SMASh domain is attached to a synTF comprising a regulator protein that is an inducer proximity domain pair (IPD), or a cytosolic sequestering protein (e.g., see FIG. 6B). In alternative embodiments, the regulator protein can be a SMASh domain (i.e., the SMASh domain replaces a self-cleaving protease regulator protein in the synTF) (see, e.g., FIG. 6A).

In all aspects of the methods, systems and compositions disclosed herein, a SMASh domain comprises a self-cleaving protease and a degron domain. In some embodiments, the self-cleaving protease is a NS3 protease or variant thereof as disclosed herein. In some embodiments the SMASh domain comprises NS3 protease domain a partial NS3 helical domain and NS4A domain, and can be fused to the N-terminal or C-terminal of a synTF described herein. Without being limited to theory and by way of explanation only, when a SMASh domain is attached to a synTF as disclosed herein, and when there is an inhibitor of the SMASh domain self-cleaving protease present, both the SMASh domain and the attached synTF are targeted for degradation. This is referred to as "SynTF-degradation" and results in the synTF being "SynTF-OFF"—that is because the synTF is degraded, the synTF cannot bind to the DBM, or regulate the expression of the gene of interest, regardless of the type of effector domain present in the synTF. Conversely, when an inhibitor of the self-cleaving protease is absent, the self-cleaving protease cleaves (or uncouples) the SMASh domain from the synTF, and only the SMASh domain is targeted for degradation, and the activity of the released synTF is regulated by way of the regulator protein. As such, when a SMASh domain is attached to the synTF, in the absence of the protease inhibitor, it is referred to "SMASh-degradation" and results in the synTF being "SynTF-ON" enabling the synTF to be regulated by the regulator protein, and gene expression can occur or be repressed depending on whether the ED is a transcription activator or repressor protein, respectively. Accordingly, the presence of a SMASh domain attached to the synTF enables a second level of control for the expression of the GOI in addition to the regulator protein.

In some embodiments, the SMASh domain by itself serves as the regulator protein of a synTF (i.e., SMASh domain replaces a self-cleaving protease regulator protein), and is referred to as an Induced Degradation Domain SynTF (e.g., see FIG. 6A). In such embodiments, where the SMASh domain serves as the regulator protein, the SMASh domain can be attached to either the ED or the DBD of the synTF, and in the absence of a NS3 protease, the NS3 protease is active and the SMASh domain uncouples from the synTF, thereby resulting in only the SMASh domain being targeted for degradation, and the synTF comprising the DBD and the coupled ED enabling to control gene expression from the promoter (i.e., the DBD binds to the DBM, bringing the ED in close proximity to the promoter and turning on gene expression of the GOI if the ED is a TA, or repressing gene expression if the ED is a TR). In such an embodiment, in the absence of an agent which inhibits the regulator protein (i.e., NS3 protein), the linkage between the DBD and ED is broken or cleaved, and therefore the ED is not brought into proximity of the transcription start site of the gene (or the ED dissociates from the start site), and therefore the TA can no longer initiate gene expression of the GOI, or alternatively a RP can no longer repress gene expression of the gene of interest.

In some embodiments, where the SMASh domain is attached to translocation domain synTF (e.g., where the regulator protein is a sequestering protein), or a heterodimerization domain synTF (i.e., where the regulator protein is pair of inducible proximity domains (IPD pair)), the SMASH domain can be referred to as a "SMASh tag" and can be attached to the C-terminal or N-terminal of a synTF (see, e.g., FIG. 6B or FIG. 16A). By way of an example only, a C-terminal SMASh tag is attached to the C-terminal of an ED or regulator protein of a synTF can comprise in the following N-terminal to C-terminal order: a NS3 cleavage site, at least one linker, a NS3 domain, a NS3 partial helicase, a NS4A domain, wherein the SMASh tag is fused to the C-terminus of the effector domain of the synTF. In some embodiments and by way of an example only, where a SMASh tag is fused to the N-terminus of a synTF (referred to herein as a "N-terminal SMASh tag"), the SMASh tag comprises in a N-terminal to C-terminal order: at least one Linker, a NS3 domain, a NS3 partial helicase, a NS4 domain, and a NS3 cleavage site, wherein the SMASh tag is fused to the N-terminus of the synTF.

Another aspect of the technology disclosed herein relates to a system for controlling gene expression of a gene of interest (GOI), where the system comprises a synTF described herein and a nucleic acid construct comprising the elements that the synTF binds to regulate gene expression. In particular, in some aspects, the system comprising (i) at least one synthetic transcription factor (synTF) as disclosed herein, and (ii) at least a nucleic acid construct, where the synTF comprises at least one DNA binding domain (DBD), a transcriptional effector domain (ED), and at least one regulator protein (RP), and where the ED is directly or indirectly coupled or linked to the DBD, and where the coupling is regulated by the at least one RP, or wherein the cellular localization of the ED linked to the DBD is regulated by the at least one RP, and where the at least one RP is regulated by an RP inducer, where the DBD can bind to a target DNA binding motif (DBM) located upstream of a promoter operatively linked to a gene, and where the nucleic acid construct comprises (i) at least one target DNA binding motif (DBM) comprising a target nucleic acid for binding of the at least one DBD of the synTF, and (ii) a promoter sequence located 3' of the at least one DBM, and (iii) a gene of interest (GOI) operatively linked to the promoter sequence. In some embodiments where the regulator protein of the synTFs regulates the coupling of the ED to the DBD (e.g., protease domain synTF or induced proximity domain synTFs), in the presence of the RP inducer, the coupling of the ED to the DBD of the synTF is maintained, enabling the ED to be in proximity to the promoter sequence when the DBD binds to the DNA binding motif (DBM), where the ED controls the expression of the gene of interest ("ED-on"). In embodiments where the ED is a transcriptional activator (TA), it results in turning on gene expression ("TA-on" (expression)), whereas in embodiments where the ED is a transcriptional repressor protein (TR), it inhibits or represses gene expression ("TR-on" (no expression)). In contrast, where the RP inducer is absent, the coupling of the ED to the DBD of the synTF is severed, preventing the ED from being in proximity to the promoter sequence when the DBD binds to the DNA binding motif (DBM), preventing gene expression of the gene of interest ("ED-off"). In embodiments where the ED is a transcriptional activator (TA), it results in turning off the gene expression ("TA-off" (no expression)), whereas in embodiments there the ED is a transcriptional repressor protein (TR), it turns on gene expression ("TR-off"/Repression-off, therefore enabling gene expression).

In embodiments where the regulator protein of the synTF regulates the cellular localization of the synTF (DBD and linked ED), when an RP inducer is present, the ED coupled to the DBD of the synTF is not sequestered in the cytosol, enabling the DBD to bind to the DNA binding motif (DBM) and enabling the transcriptional effector domain (ED) to be in proximity to the promoter sequence to control the expression of the gene of interest ("ED-on"). In embodiments where the ED is a transcriptional activator (TA), it results in turning on gene expression ("TA-on" (expression)), whereas in embodiments where the ED is a transcriptional repressor protein (TR), it inhibits or represses gene expression ("TR-on" (no expression)).

Moreover, when the RP inducer is absent, the ED coupled to the DBD of the synTF is sequestered in the cytosol, preventing the DBD of the synTF from binding to the DBM, and preventing the effector domain (ED) from being in proximity to the promoter sequence, preventing expression of the gene of interest ("ED-off"). In embodiments where the ED is a transcriptional activator (TA), it results in turning off the gene expression ("TA-off" (no expression)), whereas in embodiments where the ED is a transcriptional repressor protein (TR), it turns on gene expression ("TR-off"/Repression-off, therefore enabling gene expression).

TABLE 17 table summarizing presence or absence of regulator protein inducers on ultimate expression of the gene of interest.

| SynTF | RP inducer → effect on the SynTF binding to the DBM | Effector domain | Gene expression ON or OFF |
|---|---|---|---|
| Protease domain synTF | Present → ED-On | TA → "TA-on" | ON |
| | | RP → "RP-on" | OFF |
| | Absent → ED-Off | TA → "TA-off" | OFF |
| | | RP → "RP-off" | ON |
| Induced proximity domain synTF | Present → ED-On | TA → "TA-on" | ON |
| | | RP → "RP-on" | OFF |
| | Absent → ED-Off | TA → "TA-off" | OFF |
| | | RP → "RP-off" | ON |
| Translocation domain synTF | Present → ED-On | TA → "TA-on" | ON |
| | | RP → "RP-on" | OFF |
| | Absent → ED-Off | TA → "TA-off" | OFF |
| | | RP → "RP-off" | ON |
| Induced degradation domain synTF | Present → ED-Off, Syn-degradation | TA → "TA-off" | OFF |
| | | RP → "RP-off" | ON |
| | Absent → ED-On, SMASh degradation | TA → "TA-on" | ON |
| | | RP → "RP-on" | OFF |

Accordingly, whether gene expression of the GOI occurs is dependent on 3 levels of control, including but not limited to; (i) the type of regulator protein in the synTF, (ii) the presence or absence of a regulator protein inducer (RP inducer), and (iii) the type of effector domain.

Moreover, in some embodiments, the system for controlling gene expression can be configured for an additional level of control for the gene expression, depending whether there is a SMASh domain attached to the synTF, as disclosed herein. For example, attachment of a SMASh domain to a synTF will result in the following outcomes: if an inhibitor to the SMASh protease is present, the SMASh protease activity is inhibited, resulting in the synTF being degraded ("Syn-degradation") and preventing the DBD of the synTF binding to the DBM and controlling the expression or repression of the gene of interest ("synTF-degradation"; TA-off (no expression), TR-off (yes-expression). In alternative embodiments, if an inhibitor to the SMASh protease is absent, the SMASh protease is active and self cleaves/uncouples from the synTF, resulting the SMASh domain being targeted for degradation and allowing the DBD of the synTF to bind to the DBM and the ED of synTF to control the expression of the gene of interest ("SMASh-degradation, TA-on (yes-expression), TR-on (no-expression).

Other aspects of the technology described herein relate to a cell comprising the nucleic acid sequences as disclosed herein for binding of the synTF to regulate the expression of the gene of interest, and also a nucleic acid encoding the synthetic transcription factor. In some embodiments, the nucleic acid sequences are on separate constructs, and in some embodiments, they are the same construct, as disclosed herein and referred to as a "single vector".

Other embodiments will become readily apparent from the disclosure. Aspects of the present invention teach certain benefits in construction and use which give rise to the exemplary advantages described below.

Other features and advantages of aspects of the present invention will become apparent from the following more detailed description, taken in conjunction with the accom-

BRIEF DESCRIPTION OF THE DRAWINGS

FIG. 1A is a schematic showing the design of synTFs based on orthogonal 6-unit ZF arrays. FIG. 1B is a schematic showing a synTF and reporter system. FIG. 1C is a bar graph showing that synTFs robustly activate corresponding integrated reporters, across a library of cognate synTF/DBM pairs; note that mCherry expression occurred only in the presence of a specific ZF-p65 synTF and not in the absence of a TF or in the presence of GFP-p65. FIG. 1D is a heatmap showing the co-expression of specific synTFs and reporters; note that mCherry reporter is activated by a synthetic operator and its cognate synTF. FIG. 1E-1G is a series of scatterplots showing transcriptome profiling of human cells expressing synTFs, including ZF1-p65 (FIG. 1E), ZF3-p65 (FIG. 1F), and ZF10-p65 (FIG. 1G), which reveals highly specific, orthogonal regulation of the synTFs. FIG. 1H is a bar graph showing a transcriptome profiling of synTFs compared to Gal4 and TetR. Differentially regulated transcripts=Log 2|fold change|>1; FDR<0.1 (for all 3 independent replicates).

FIG. 5A is a schematic showing a synTF regulated by NS3. GRZ indicates grazoprevir (a small molecule inhibitor of NS3). FIG. 5B is a schematic showing the system in the absence of the small molecule. NS3 protease self-excision leads to decoupling of ZF (zinc finger binding domain or DNA binding domain (DBD)) and ED (effector domain), thus permitting no transcriptional regulatory activity. FIG. 5C is a schematic showing the system in the presence of the small molecule. NS3 protease activity inhibition allows local coupling of ZF and ED, thus permitting transcriptional regulatory activity.

FIG. 6A-6B is a series of schematics showing an exemplary synTF regulated by induced degradation. FIG. 6A is a schematic showing a synTF regulated by SMASh. FIG. 6B is a schematic showing a regulated transcription factor utilizing both the ERT2 and SMASh domains. The SMASh domain was placed on the C-terminus of an ERT2-containing synTF ("C-terminal SMASh", top) and on the N-terminus of an ERT2-containing synTF ("N-terminal SMASh", bottom).

FIG. 7A shows a schematic of an induced proximity domain (IPD) that couples the DBD (or ZF1) to the ED. In this exemplary embodiment, ABA functions as an inducer ligand to maintain coupling of ZF1 to the ED. FIG. 7A also shows the output fluorescence measured as a function of several different ABA treatment concentrations as indicated (dose response). FIG. 7B shows that administration of a small molecule (ABA) led to temporal activation of a fluorescent protein output from a ZF-responsive promoter in Jurkat cell lines. This level of expression was compared to an untreated cell line which did not activate output expression. FIG. 7C shows that removal of a small molecule (ABA) after four days led to temporal de-activation of a fluorescent protein output from a ZF-responsive promoter in Jurkat cell lines. This level of expression was compared to an untreated cell line which did not activate output expression. The time points measured on the chart begin on the day of drug removal ("day 0").

FIG. 8A shows an exemplary synTF with a DBD (or ZF3) fused to the ED (i.e., p63) with the cytosolic sequestering protein ERT2. FIG. 8A also shows the output fluorescence measured as a function of several different 4OHT treatment concentrations as indicated (dose response). FIG. 8B shows that administration of a small molecule (4OHT) led to temporal activation of a fluorescent protein output from a ZF-responsive promoter in Jurkat cell lines. This level of expression was compared to an untreated cell line which did not activate output expression. FIG. 8C shows that removal of a small molecule (4OHT) after four days led to temporal de-activation of a fluorescent protein output from a ZF-responsive promoter in Jurkat cell lines. This level of expression was compared to an untreated cell line which did not activate output expression. The time points measured on the chart begin on the day of drug removal ("day 0").

FIG. 9A shows an exemplary synTF with a DBD (or ZF10) coupled to the protease which is coupled to the ED (i.e., p65). FIG. 9A also shows the output fluorescence was measured as a function of several different grazoprevir treatment concentrations as indicated (dose response). FIG. 9B shows that administration of a small molecule (grazoprevir) led to temporal activation of a fluorescent protein output from a ZF-responsive promoter in Jurkat cell lines. This level of expression was compared to an untreated cell line which did not activate output expression. FIG. 9C shows that removal of a small molecule (grazoprevir) after four days led to temporal de-activation of a fluorescent protein output from a ZF-responsive promoter in Jurkat cell lines. This level of expression was compared to an untreated cell line which did not activate output expression. The time points measured on the chart begin on the day of drug removal ("day 0").

FIG. 10A is a schematic showing three exemplary synTFs: a heterodimerization domain synTF, a cytosolic sequestering domain synTF, and a repressible protease synTF, which are regulated by ABA, 4OHT, or grazoprevir, respectively. FIG. 10B is a schematic showing the reporter system. FIG. 10C-10D shows a series of line graphs (left) showing synTF activation of the reporter in HEK293 cells (FIG. 10C) or Jurkat cells (FIG. 10D) at a varying times and doses of small molecule (does are indicated by the shade of grey, with darker grey corresponding to the highest dose indicated). FIG. 10C-10D also shows a series of bar graphs (right) showing synTF activation of the reporter in HEK293 cells (FIG. 10C) or Jurkat cells (FIG. 10D) at D4 and the highest dose of small molecule (1 mM for ABA; 4 uM for 4OHT; 4 uM for GRZ). In FIG. 10C-10D shows, the top graphs correspond to ABA-regulated synTF, middle graphs to 4OHT-regulated synTF, and bottom-graphs to grazoprevir-regulated synTF. In FIG. 10C-10D this enhanced level of expression was compared to an untreated cell line which did not activate output expression.

FIG. 11A is a schematic showing the reporter system and the inducible synTFs comprising a repressor as the effector domain. FIG. 11B is a series of graphs showing that administration of a small molecule (top graphs: ABA, middle graphs: 4OHT; bottom graphs: GRZ) led to temporal silencing of a fluorescent protein output from a ZF-responsive promoter in HEK293 cell lines. This decreased level of expression was compared to an untreated cell line which did not silence output expression. FIG. 11B shows a series of line graphs (left) showing synTF repression of the reporter in HEK293 cells at a varying times and a series of bar graphs (right) showing synTF repression of the reporter in HEK293 cells at day 8.

FIG. 12A is a schematic showing the reporter system and the inducible synTF comprising a repressor as the effector domain. FIG. 12B-12C is a series of graphs showing that administration of a small molecule (grazoprevir) led to temporal silencing of a fluorescent protein output from a ZF-responsive promoter in HEK293 (FIG. 12B) and Jurkat cell lines (FIG. 12C). This decreased level of expression was compared to an untreated cell line which did not silence output expression. FIG. 12B-12C shows a series of line graphs (left) showing synTF repression of the reporter in cells at a varying times and a series of bar graphs (right) showing synTF repression of the reporter in cells at day 8.

FIG. 13A is a schematic showing the CD19-CAR expression system and an inducible synTF. Shown is a repressible protease synTF comprising NS3; however, any synTF as discussed can be used to regulate the expression of the CD19-CAR GOI according to the methods disclosed herein. FIG. 13B shows a line graph (left) showing synTF activation of CD-19 synTF expression in CD4+ primary T cells at a varying times and several different grazoprevir treatment concentrations and a bar graphs (right) showing synTF activation of CD-19 synTF expression in CD4+ primary T cells at day 3. This enhanced level of expression was compared to an untreated cell line which did not activate output expression. FIG. 13C-13D show that subsequent co-culture of these primary cells with CD19 antigen-presenting target cells (CD19+ NALM cells) resulted in T-cell activation, measured by enhanced production of cytokines. This enhanced level of cytokine production was compared to an untreated cell line which did not activate cytokine expression. FIG. 13C-13D are a series of bar graphs showing IFNγ expression (FIG. 13C) and IL-2 expression (FIG. 13D) at several different grazoprevir treatment concentrations at D1 or D2.

FIG. 14A is a schematic showing the CD19-CAR and IL-4 expression systems and the exemplary inducible synTFs: a repressible protease synTF to regulate CD19-CAR and a cytosolic sequestering synTF to regulate expression of IL4. FIG. 14B is a series of line graphs showing CD19-CAR expression (top graph) and IL-4 expression (bottom graph) in the presence or absence of GZV or 4OHT, as indicated, at varying time points.

FIG. 15A-15B are a series of schematics showing that this inducible activation can be achieved through the delivery of separate nucleic acid constructs for NS3-synTF expression which then controls IL10 production ("double lentiviral vector", FIG. 15A), or through the delivery of a single nucleic acid construct controlling the expression of the NS3-synTF, as well as regulating IL10 production ("single lentiviral vector", FIG. 15B). FIG. 15C is a bar graph showing IL-10 in the presence (dark grey) or absence (light grey) of 1 uM GZV for 2 days in the double vector or single vector system.

FIG. 16A is a schematic showing N-terminal SMASh synTF and C-terminal SMASh synTF. FIG. 16B is a line graph showing reporter expression following removal of 4OHT and the presence or absence of grazoprevir, as indicated.

FIG. 19 is a schematic showing an annotated sequence of SEQ ID NO: 4, [ABI]-[ZF]-[2A]-[p65]-[PYL] (903 aa); shown N-terminal to C-terminal; bold text indicates the Zinc Finger Domain; *bold italicized text* indicates the Nuclear Localization Sequence; zig zag underlined text indicates a Linker; *italicized double underlined text* indicates the restriction sites; bold zig zag underlined text indicates the ABI1cs CO1 Domain; dot underlined text indicates 2A Ribosomal Skip Sequence; *bold italicized dot dash underlined text* indicates p65 (amino acids 361-551) Activation Domain; *italicized text* indicates the PYL1cs Domain; plain text "xxxxxxx" indicates six ZF helices, e.g., from N terminus to C terminus: helix 1, helix 2, helix 3, helix 4, helix 5, and helix 6. Following translation of the polypeptide, the 2A sequence, which is a self-cleaving peptide, cleaves the polypeptide into two polypeptides: [ABI]-[ZF] and [p65]-[PYL], which in the presence of ABA can form a [p65]-[PYL]•ABA•[ABI]-[ZF] complex, thus coupling the DBD (ZF) and ED (p65).

FIG. 20 is a schematic showing an annotated sequence of SEQ ID NO: 5, [ABI]-[ZF]-[2A]-[KRAB]-[PYL] (808 aa); shown N-terminal to C-terminal; bold text indicates the Zinc Finger Domain; **bold *italicized* text** indicates the Nuclear Localization Sequence; zig zag underlined text indicates a Linker; *italicized double underlined text* indicates the restriction sites; bold zig zag underlined text indicates the ABI1cs CO1 Domain; dot underlined text indicates 2A Ribosomal Skip Sequence; *bold italicized dot dash underlined text* indicates KRAB Repression Domain; *italicized text* indicates the PYL1cs Domain; plain text "xxxxxxx" indicates six ZF helices, e.g., from N terminus to C terminus: helix 1, helix 2, helix 3, helix 4, helix 5, and helix 6. Following translation of the polypeptide, the 2A sequence, which is a self-cleaving peptide, cleaves the polypeptide into two polypeptides: [ABI]-[ZF] and [KRAB]-[PYL], which in the presence of ABA can form a [KRAB]-[PYL]•ABA•[ABI]-[ZF] complex, thus coupling the DBD (ZF) and ED (KRAB).

FIG. 21 is a schematic showing an annotated sequence of SEQ ID NO: 6, [ZF]-[p65]-[ERT2] (692 aa); shown N-terminal to C-terminal; bold text indicates the Zinc Finger Domain; **bold *italicized* text** indicates the Nuclear Localization Sequence; zig zag underlined text indicates a Linker; *italicized double underlined text* indicates the restriction sites; bold zig zag underlined text indicates the ERT2 Domain; *bold italicized dot dash underlined text* indicates p65 (amino acids 361-551) Activation Domain; *italicized text* indicates the PYL1cs Domain; plain text "xxxxxxx" indicates six ZF helices, e.g., from N terminus to C terminus: helix 1, helix 2, helix 3, helix 4, helix 5, and helix 6.

FIG. 22 is a schematic showing an annotated sequence of SEQ ID NO: 7, [KRAB]-[ZF]-[ERT2] (605 aa); shown N-terminal to C-terminal; bold text indicates the Zinc Finger Domain; **bold *italicized* text** indicates the Nuclear Localization Sequence; zig zag underlined text indicates a Linker; *italicized double underlined text* indicates the restriction sites; bold zig zag underlined text indicates the ERT2 Domain; *bold italicized dot dash underlined text* indicates KRAB Repression Domain; plain text "xxxxxxx" indicates six ZF helices, e.g., from N terminus to C terminus: helix 1, helix 2, helix 3, helix 4, helix 5, and helix 6.

FIG. 23 is a schematic showing an annotated sequence of SEQ ID NO: 8, [ZF]-[NS3]-[p65] (704 aa); shown N-terminal to C-terminal; *italicized text* indicates the restriction sites; bold text indicates the Zinc Finger Domain; **bold *italicized* text** indicates the 3× FLAG Tag+ Nuclear Localization Sequence; zig zag underlined text underlined text indicates a Linker; *italicized double underlined text* indicates NS3 Cleavage Site; bold zig zag underlined text indicates the NS3 Domain; dot underlined text indicates HA Tag; *bold italicized dot dash underlined text* indicates p65 (amino acids 361-551) Activation Domain; plain text "xxxxxxx" indicates six ZF helices, e.g., from N terminus to C terminus: helix 1, helix 2, helix 3, helix 4, helix 5, and helix 6.

FIG. 24 is a schematic showing an annotated sequence of SEQ ID NO: 9, [KRAB]-[NS3]-[ZF] (609 aa); shown N-terminal to C-terminal; *italicized text* indicates the restriction sites; bold text indicates the Zinc Finger Domain; **bold *italicized* text** indicates the 3× FLAG Tag+Nuclear Localization Sequence; zig zag underlined text indicates a Linker; *italicized double underlined text* indicates NS3 Cleavage Site; bold zig zag underlined text indicates the NS3 Domain; dot underlined text indicates HA Tag; *bold italicized dot dash underlined text* indicates KRAB Repression Domain; plain text "xxxxxxx" indicates ZF six helices, e.g., from N terminus to C terminus: helix 1, helix 2, helix 3, helix 4, helix 5, and helix 6.

FIG. 25 is a schematic showing an annotated sequence of SEQ ID NO: 10, [ZF]-[p65]-[ERT2]-[SMASh] (998 aa); shown N-terminal to C-terminal; bold text indicates the Zinc Finger Domain; **bold *italicized* text** indicates the FLAG tag; zig zag underlined text indicates a Linker; *italicized double underlined text* indicates the restriction sites; bold zig zag underlined text indicates the ERT2 Domain; dot underlined text indicates NS3 Cleavage Site; *bold italicized dot dash underlined text* indicates p65 (amino acids 361-551) Activation Domain; *italicized text* indicates the NS3 Protease Domain; bold dash underlined text indicates NS3 Partial Helicase; *italicized zig zag underlined text* indicates NS4A Domain; plain text "xxxxxxx" indicates six ZF helices, e.g., from N terminus to C terminus: helix 1, helix 2, helix 3, helix 4, helix 5, and helix 6.

FIG. 26 is a schematic showing an annotated sequence of SEQ ID NO: 11, [SMASh]-[ZF]-[p65]-[ERT2] (997 aa); shown N-terminal to C-terminal; bold text indicates the Zinc Finger Domain; **bold *italicized text* indicates the FLAG tag; zig zag underlined underlined** indicates a Linker; *italicized double underlined text* indicates the restriction sites; bold zig zag text text indicates the ERT2 Domain; dot underlined text indicates NS3 Cleavage Site; *bold italicized dot dash underlined text* indicates p65 (amino acids 361-551) Activation Domain; *italicized text* indicates the NS3 Protease Domain; bold dash underlined text indicates NS3 Partial Helicase; *italicized zig zag underlined text* indicates NS4A Domain; plain text "xxxxxxx" indicates six ZF helices, e.g., from N terminus to C terminus: helix 1, helix 2, helix 3, helix 4, helix 5, and helix 6.

FIG. 27 is a schematic showing an annotated sequence of SEQ ID NO: 12, [ZF]-[p65]-[SMASh]; (728 aa); shown N-terminal to C-terminal; bold text indicates the Zinc Finger Domain; **bold *italicized text*** indicates the FLAG tag; zig zag underlined text indicates a Linker; *italicized double underlined text* indicates the restriction sites; dot underlined text indicates NS3 Cleavage Site; *bold italicized dot dash underlined text* indicates p65 (amino acids 361-551) Activation Domain; *italicized text* indicates the NS3 Protease Domain; bold dash underlined text indicates NS3 Partial Helicase; *italicized zig zag underlined text* indicates NS4A Domain; plain text "xxxxxxx" indicates six ZF helices, e.g., from N terminus to C terminus: helix 1, helix 2, helix 3, helix 4, helix 5, and helix 6.

FIG. 28 is a schematic showing an annotated sequence of SEQ ID NO: 13, [KRAB]-[ZF]-[ERT2]-[SMASh]; (878 aa); shown N-terminal to C-terminal; bold text indicates the Zinc Finger Domain; **bold *italicized text*** indicates the FLAG tag; zig zag underlined text indicates a Linker; *italicized double underlined text* indicates the restriction sites; dot underlined text indicates NS3 Cleavage Site; *bold italicized dot dash underlined text* indicates KRAB Repressor Domain; bold zig zag underlined text indicates the ERT2

Figure 1A:
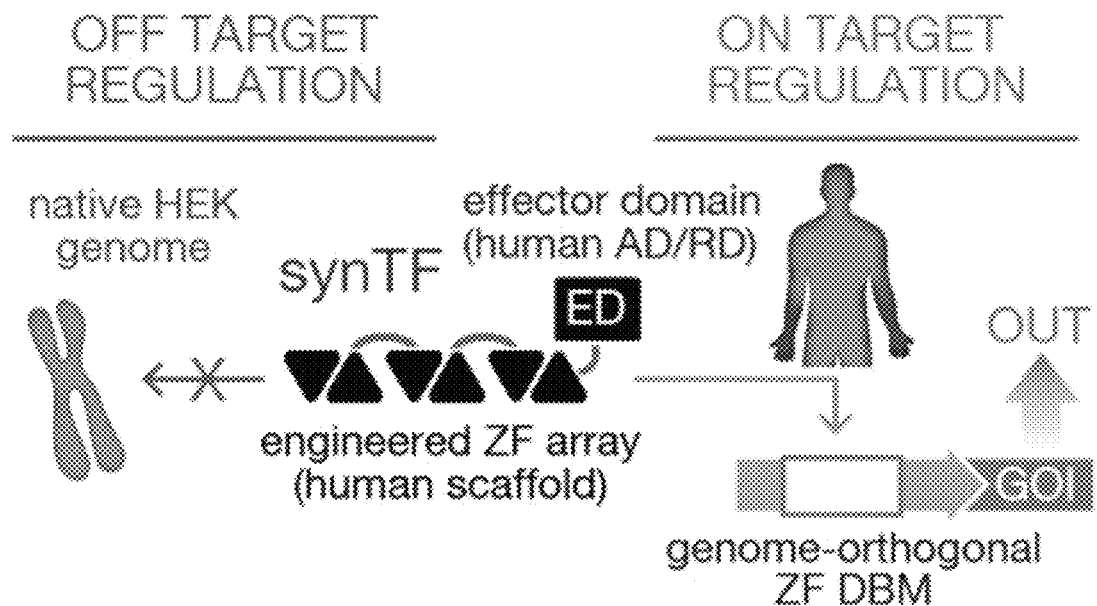
FIG. 1A-1H is a series of schematics and graphs showing the design and characterization of mammalian synTFs based on orthogonal ZF arrays.
Figure 1B:
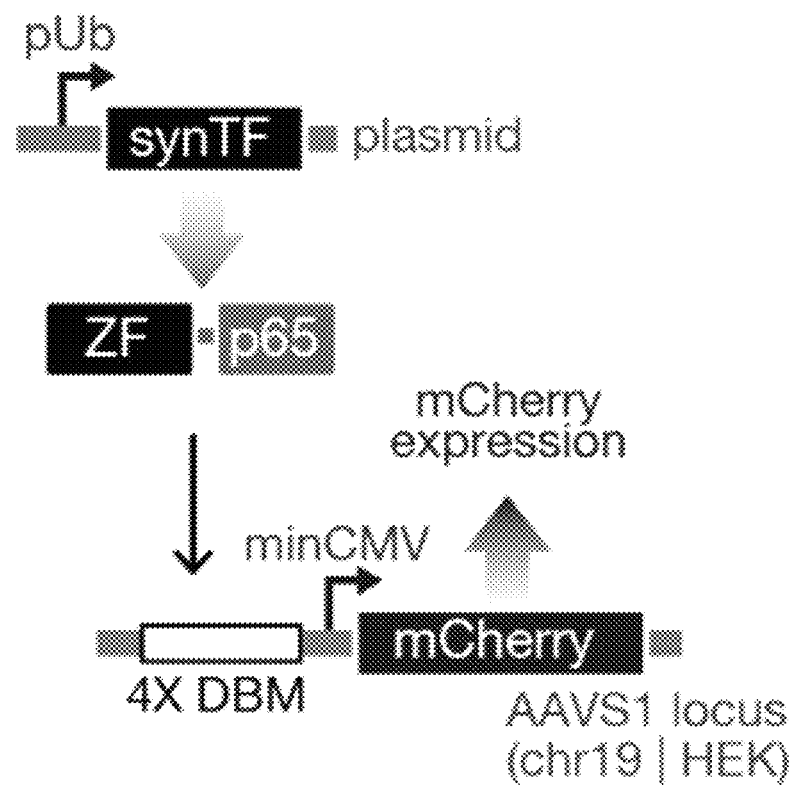
Figure 1C:
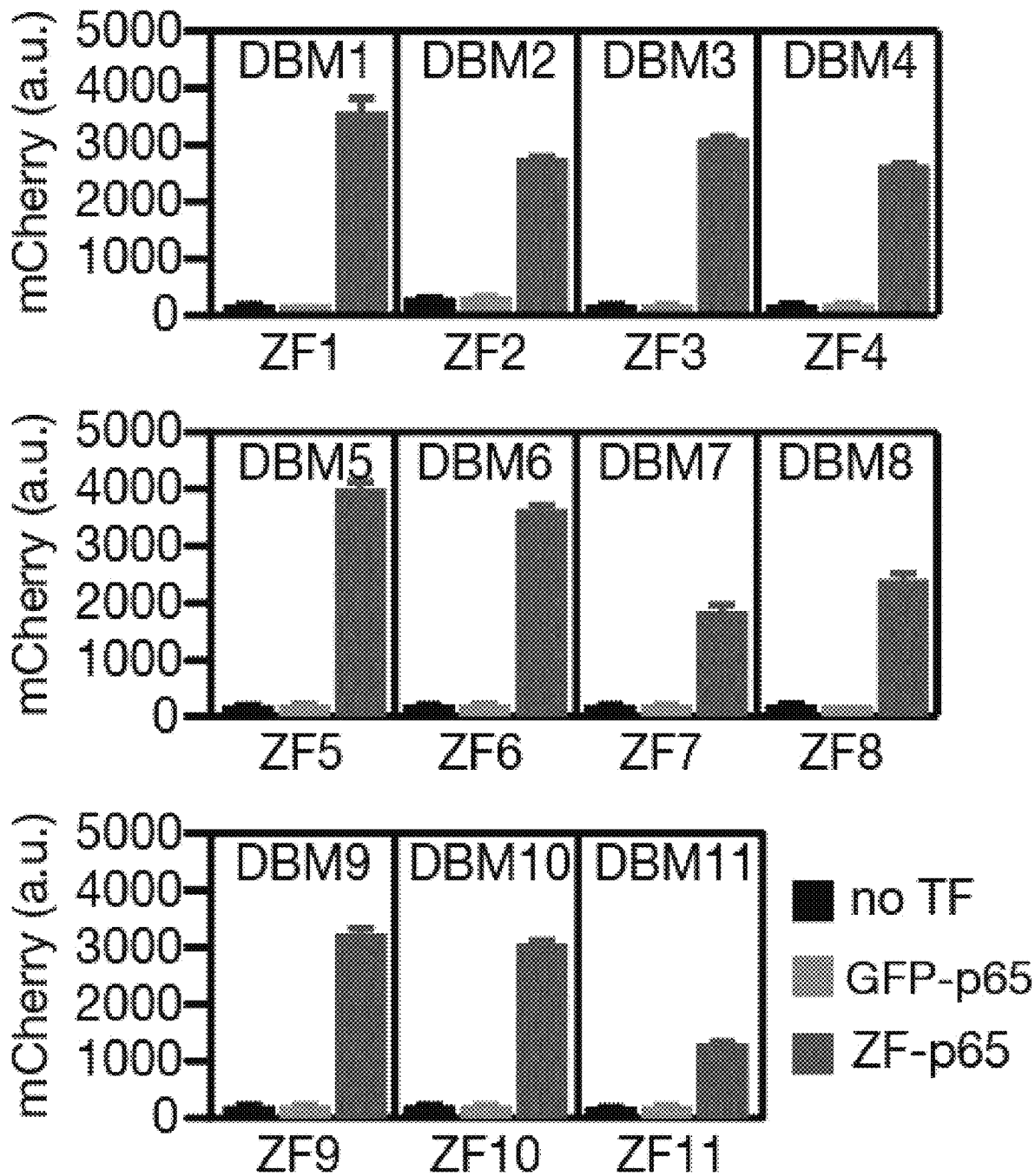
Figure 1D:
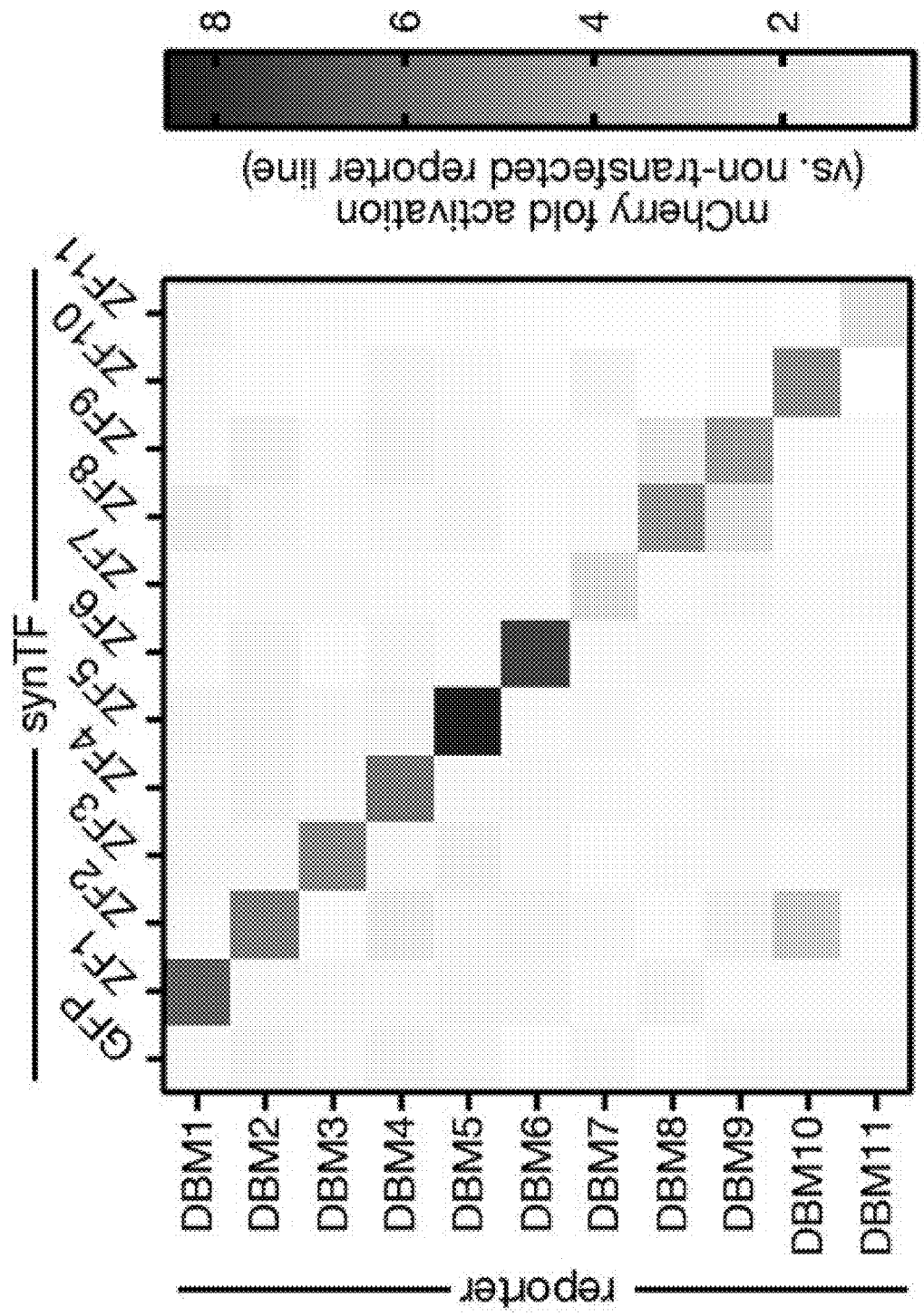
Figure 1F:
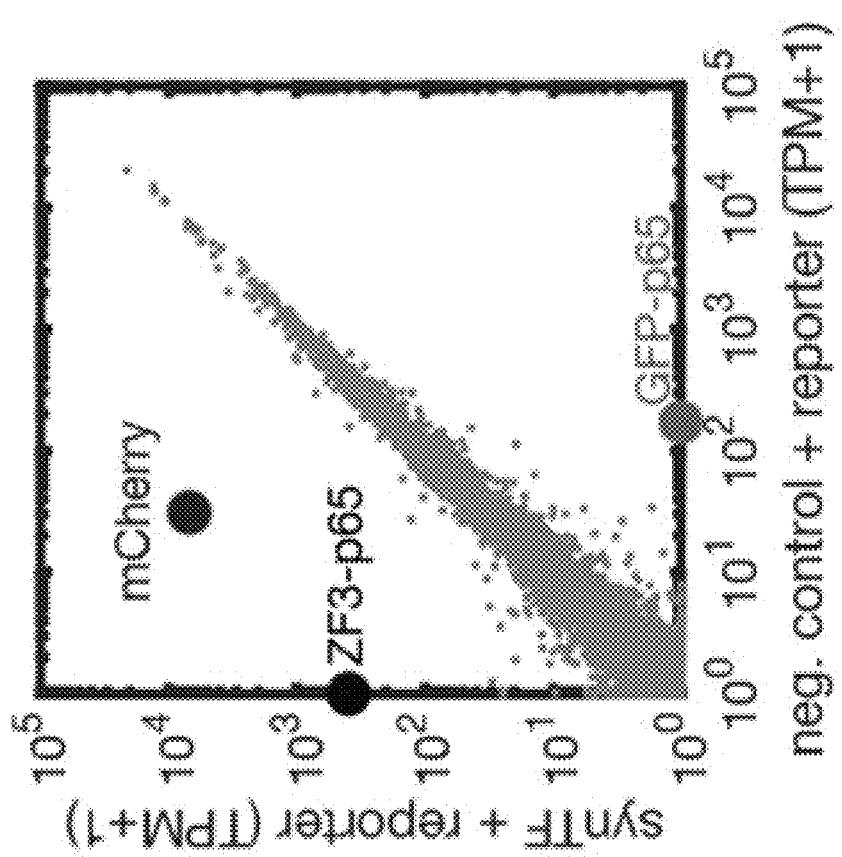
Figure 1E:
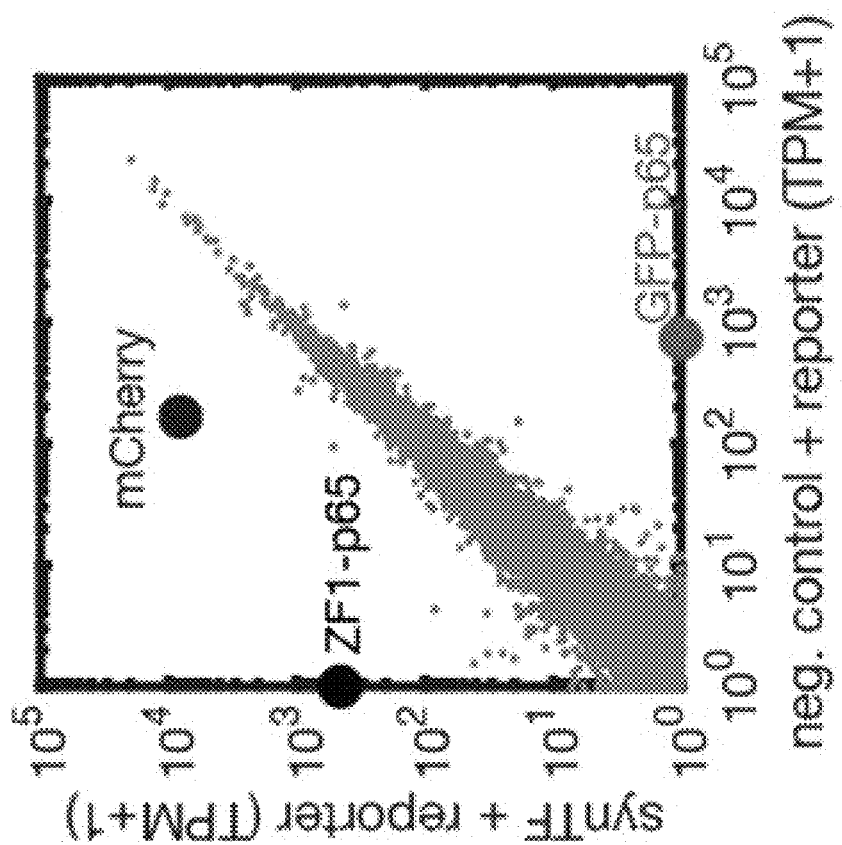
Figure 1G:
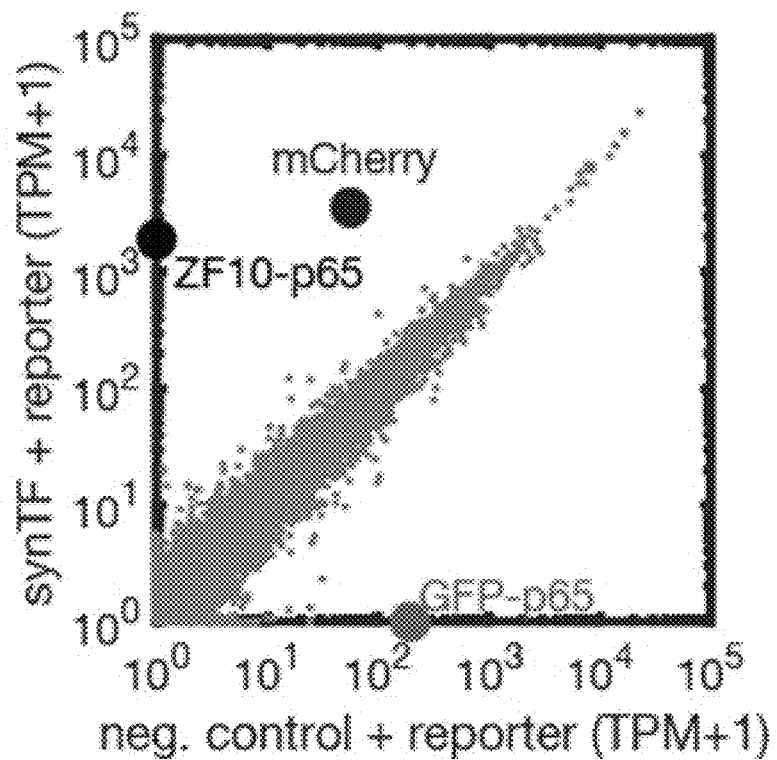
Figure 1H:
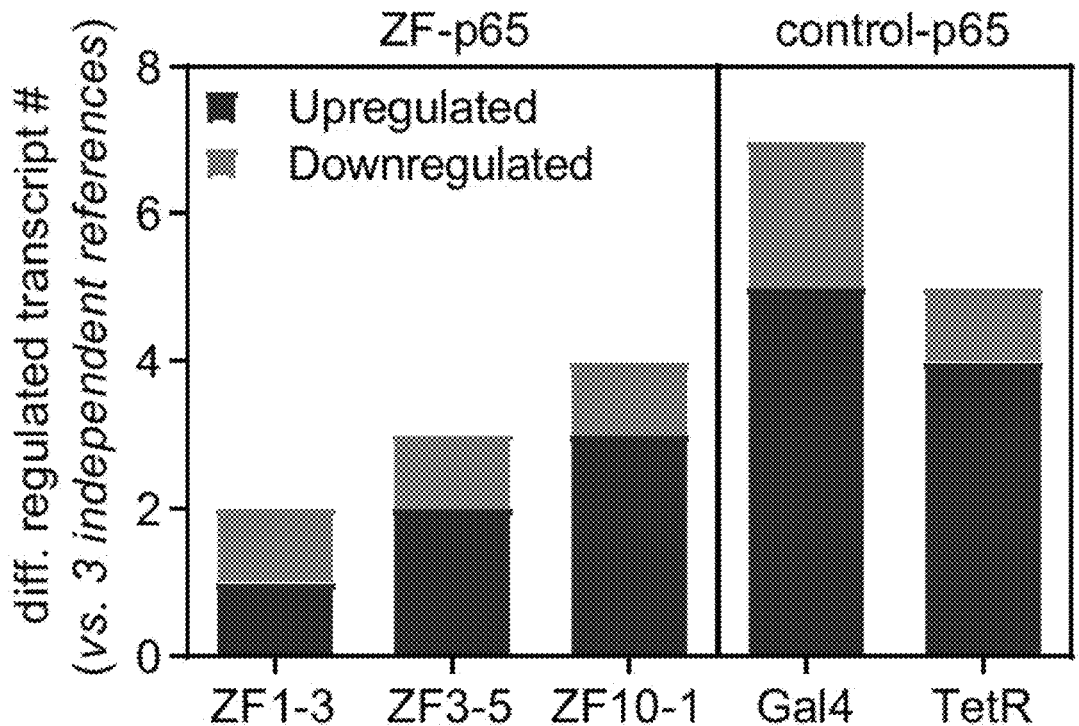

Domain; *italicized text* indicates the NS3 Protease Domain; bold dash underlined text indicates NS3 Partial Helicase; *italicized zig zag underlined text* indicates NS4A Domain; plain text "xxxxxxx" indicates six ZF helices, e.g., from N terminus to C terminus: helix 1, helix 2, helix 3, helix 4, helix 5, and helix 6.

FIG. 29 is a schematic showing an annotated sequence of SEQ ID NO: 14, [HP1a]-[ZF]-[ERT2]-[SMASh], (1003 aa); shown N-terminal to C-terminal; bold text indicates the Zinc Finger Domain; *bold italicized text* the FLAG tag; zig zag underlined text indicates a Linker; *italicized double underlined text* indicates the restriction sites; dot underlined text indicates NS3 Cleavage Site; *bold italicized dot dash underlined text* indicates HP1a Repressor Domain; bold zig zag underlined text indicates the ERT2 Domain; *italicized text* indicates the NS3 Protease Domain; bold dash underlined text indicates NS3 Partial Helicase; *italicized zig zag underlined text* italicized zig zag underlined text indicates NS4A Domain; plain text "xxxxxxx" indicates six ZF helices, e.g., from N terminus to C terminus: helix 1, helix 2, helix 3, helix 4, helix 5, and helix 6.

FIG. 30 is a schematic showing an annotated sequence of SEQ ID NO: 15, [EED]-[ZF]-[ERT2]-[SMASh], (1253 aa); shown N-terminal to C-terminal; bold text indicates the Zinc Finger Domain; *bold italicized text* indicates the FLAG tag; zig zag underlined text indicates a Linker; *italicized double underlined text* indicates the restriction sites; dot underlined text indicates NS3 Cleavage Site; *bold italicized dot dash underlined text* indicates HP1a Repressor Domain; bold zig zag underlined text indicates the ERT2 Domain; *italicized text* indicates the NS3 Protease Domain; bold dash underlined text indicates NS3 Partial Helicase; *italicized zig zag underlined text* indicates NS4A Domain; plain text "xxxxxxx" indicates six ZF helices, e.g., from N terminus to C terminus: helix 1, helix 2, helix 3, helix 4, helix 5, and helix 6.

Figure 31:
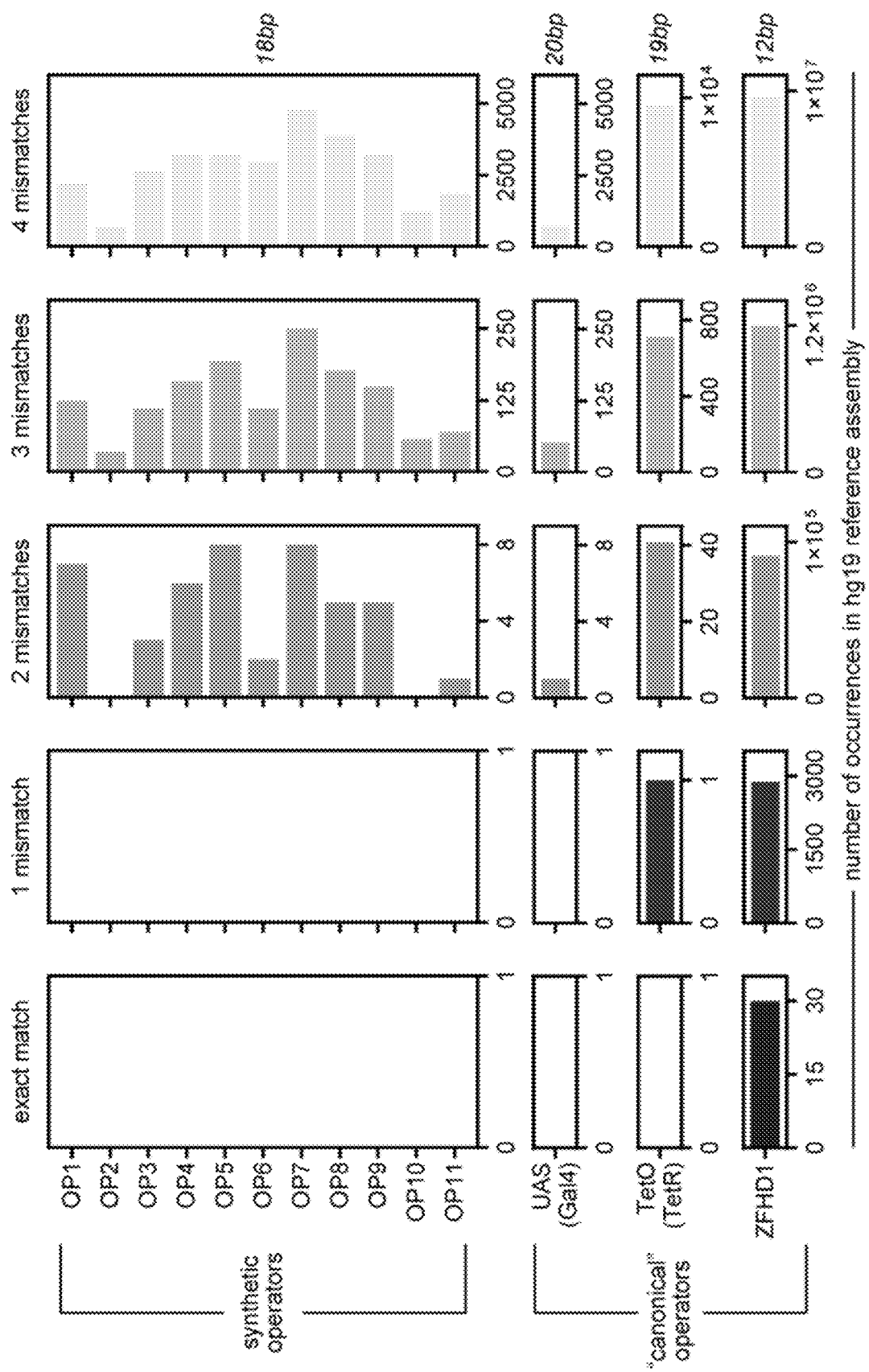

FIG. 31 is a series of graphs showing the identification of synthetic transcriptional operator sequences orthogonal to the human genome. A bioinformatic string matching algorithm called "Biostrings" was used to evaluate the occurrence of the operator sequences in the human genome. The x-axis here represents the number of occurrences of particular string(s) in the hg19 ref assembly; note that the scale changes for different sets and panels. On the top panel are the 11 "synthetic operators" and the instances of either exact or all possible mismatched sequences: this algorithm showed that there were no exact or 1-2 mismatch sequences for these, suggesting that the sequence composition can be considered genomically-distant. Several canonical TF operator sequences were also compared to the human genome. The synthetic operators described herein perform better relative to these "heterologous" recognition sequences of similar or shorter lengths.

The following abbreviations used herein are defined as follows: synTF (synthetic transcription factor); ZF (zinc finger); HEK (human embryonic kidney 293 cells); ED (effector domain); AD (activator domain); RD (repressor domain); GOI (gene of interest); OUT (output); DBM (DNA binding motif); pUb (Ubiquitin C promoter); p65 (Transcription Factor P65); minCMV (minimal cytomegalovirus promoter); AAVS1 (adeno-associated virus integration site 1); chr19 (human chromosome 19); GFP (green fluorescent protein); TPM (transcripts per million; i.e., a normalized value of each individual RNA transcript across the total pool of RNA transcripts for the sequenced samples); ABI (ABA-insensitive); PYL (PYR1-like, protein pyrabactin resistance 1-like); ABA (abscisic acid); ERT2 (a mutated variant of the estrogen receptor ligand binding domain), 4OHT (4-hydroxyrtamoxifen); NS3 (nonstructural protein 3 of HCV); GZV or GRZ (grazoprevir); SMASh (small molecule assisted shut-off); a.u. (arbitrary units or relative emission intensity); IFNγ (interferon gamma); IL-2 (interleukin 2); IL-4 (interleukin 4); CD19 (Cluster of Differentiation 19); mCh (mCherry); pSFFV (silencing-prone spleen focus forming virus promoter); minTK (minimal promoter fragment from the HSV thymidine kinase (TK) promoter); lenti (lentivirus).

DETAILED DESCRIPTION

Described herein are synTFs for use in the methods and compositions as disclosed herein, where the synTFs comprise (i) a DNA binding domain (DBD) which binds to a target nucleic acid sequence (or target DNA binding motif (DBM)), (ii) an effector domain (ED) and a regulator protein (RP), where the regulator protein controls the coupling or linkage of the DNA binding domain (DBD) with the effector domain (ED) (such coupling can also be referred to as a "mediator domain"), or controls the cellular localization of the ED, such that when the ED and DBD are attached and/or located in the nucleus, the ED can function to recruit or repress translation machinery to the promoter to regulate gene expression of a gene of interest.

In some embodiments of any of the aspects, regulator proteins can be activated or inhibited by to a variety of inputs, non-limiting examples of which include: inducers (e.g., small molecules), light-inducible control (e.g., dimerization, assembly, localization), temperature, pH, phosphorylation, oxygen, lipid, magnetic, electric, spatial mechanisms (e.g., intracellular and/or extracellular; e.g., synthetic receptors and/or soluble factors), endogenous ligands (e.g., biomarkers), cell-cycle state, native signaling pathways, or disease and/or pathogenic states (e.g., aggregation, infection).

In some embodiments of the systems, compositions and methods as disclosed herein, the regulator protein of the SynTF is selected from a protease, a pair of inducible proximity domains (IPDs), a translocation domain (i.e., a cytosolic sequestering protein), or an induced degradation domain, each of which are described herein and in more detail below.

Described herein are four general frameworks of inducible or drug-controllable synthetic transcription factors: (1) a synTF comprising a repressible protease, referred to as a repressible protease synTF; (2) a synTF comprising induced proximity domains, referred to as a induced proximity domain SynTF; (3) a synTF system comprising a cytosolic sequestering domain, referred to as a cytosolic sequestering synTF; and (4) a synTF comprising an induced degradation domain referred to as an induced degradation domain synTF. Also described herein are polynucleotides and vector encoding said synTF polypeptides, cells expressing said synTF polypeptides, pharmaceutical compositions comprising said synTF polypeptides, and methods of using said synTF polypeptides.

Described herein is a class of engineered transcription factor proteins (synTFs) and corresponding responsive artificial engineered promoters capable of precisely controlling gene expression in a wide range of eukaryotic cells and organisms, including mammalian cells. These synTFs are specifically designed to have reduced or minimal binding potential in the host genome (i.e., "orthogonal" activity to the host genome). The synTF proteins described herein comprise a DNA binding domain (DBD) which are based on engineered zinc finger (ZF) arrays that are designed to target and bind specific 18-20 nucleotide sequences that are distant and different from the host genome sequences, when the synTF proteins are used in the selected hosts. This strategy limits non-specific interactions of the synTF proteins with the host's genome; such non-specific interactions are not ideal and therefore, are not desired.

The synTFs described herein are designed, in some aspects, according to the following parameters: (1) targetable DNA sequences (also known as ZF binding sites) are identified for the ZF arrays that are specifically designed to have reduced binding potential in a host genome; (2) ZF arrays are designed and assembled; (3) synTFs are designed by coupling engineered (i.e., covalently linked) ZF arrays to transcriptional and/or epigenetic effector domains; (4) corresponding responsive promoters are designed by placing instances of the targetable DNA sequences (i.e., ZF binding sites) upstream of constitutive promoters. The targetable DNA sequences are operably linked to the promoters such that the occupancy of synTFs on the targetable DNA sequences regulates the activity of the promoter in gene expression. The combination of a synTFs and a targetable DNA sequence-promoter forms a unique expression system that is artificial, scalable, and regulatable, for the expressions of desired genes placed within the expression systems, with no or minimal effects on the expression of endogenous genes, meaning no or minimal off-site gene regulation of endogenous genes.

The synTFs described herein have reduced or minimal functional binding potential in the host genome, which provides, in part, advantages of no or minimal off-site DNA targeting by the synTFs. In addition, the synthetic ZF-based proteins (synTFs) described herein are derived from mammalian protein scaffolds, conferring minimal degree of immunogenicity over other prokaryotically-derived domains. In contrast to other classes of programmable DNA-targeting domains, these zinc-finger-based regulatory proteins are considerably smaller (~4-5×) than TALE and dCas9 proteins, less repetitive than TALE repeat proteins, and are not as constrained by lentiviral packaging limits, enabling convenient packaging in lentiviral delivery constructs and affording space for other desirable control elements.

I. Synthetic Transcription Factor Domains

In multiple aspects described herein are synTF polypeptides or synTF polypeptide systems that comprise at least one of the following domains: transcriptional effector domain, a DNA-binding domain, at least one regulator protein selected from the group consisting of: repressible protease, induced proximity domain, cytosolic sequestration domain, induced degradation domain, at least one linker peptide, at least one detectable marker, and/or self-cleaving peptide, or any combination thereof. In some embodiments of any of the aspects, a synTF polypeptide or a synTF polypeptide system collectively (i.e., the first polypeptide and/or the second polypeptide) comprises at least the following: a transcriptional effector domain, a DNA-binding domain, at least one regulator protein selected from the group consisting of: repressible protease, induced proximity domain, cytosolic sequestration domain, and/or induced degradation domain. In some embodiments of any of the aspects, a synTF polypeptide or system further comprises at least one linker peptide, or at least one detectable marker, and/or at least one self-cleaving peptide, or any combination thereof. Specific synTFs described herein are not to be construed as limitations. For example, the following combinations are contemplated herein (see e.g., Table 8):

TABLE 8

Exemplary Combinations of Domains in a synTF Polypeptide or synTF Polypeptide System.

| PRO | IPD | CS | DD | LP | DM | SP | PRO | IPD | CS | DD | LP | DM | SP |
|---|---|---|---|---|---|---|---|---|---|---|---|---|---|
|  |  |  |  |  |  |  | X | X | X |  |  | X |  |
| X |  |  |  |  |  |  |  |  |  | X |  | X |  |
|  | X |  |  |  |  |  | X |  |  | X |  | X |  |
| X | X |  |  |  |  |  |  |  | X | X |  | X |  |
|  |  | X |  |  |  |  | X | X |  | X |  | X |  |
| X |  | X |  |  |  |  |  |  | X | X |  | X |  |
|  | X | X |  |  |  |  | X |  | X | X |  | X |  |
| X | X | X |  |  |  |  |  | X | X | X |  | X |  |
|  |  |  | X |  |  |  | X | X | X | X |  | X |  |
| X |  |  | X |  |  |  |  |  |  |  | X | X |  |
|  | X |  | X |  |  |  | X |  |  |  | X | X |  |
| X | X |  | X |  |  |  |  | X |  |  | X | X |  |
|  |  | X | X |  |  |  | X | X |  |  | X | X |  |
| X |  | X | X |  |  |  |  |  | X |  | X | X |  |
|  | X | X | X |  |  |  | X |  | X |  | X | X |  |
| X | X | X | X |  |  |  |  | X | X |  | X | X |  |
|  |  |  |  | X |  |  | X | X | X |  | X | X |  |
| X |  |  |  | X |  |  |  |  |  | X | X | X |  |
|  | X |  |  | X |  |  | X |  |  | X | X | X |  |
| X | X |  |  | X |  |  |  | X |  | X | X | X |  |
|  |  | X |  | X |  |  | X | X |  | X | X | X |  |
| X |  | X |  | X |  |  |  |  | X | X | X | X |  |
|  | X | X |  | X |  |  | X |  | X | X | X | X |  |
| X | X | X |  | X |  |  |  | X | X | X | X | X |  |
|  |  |  | X | X |  |  | X | X | X | X | X | X |  |
| X |  |  | X | X |  |  |  |  |  |  |  |  | X |
|  | X |  | X | X |  |  | X |  |  |  |  |  | X |
| X | X |  | X | X |  |  |  | X |  |  |  |  | X |
|  |  | X | X | X |  |  | X | X |  |  |  |  | X |
| X |  | X | X | X |  |  |  |  | X |  |  |  | X |
|  | X | X | X | X |  |  | X |  | X |  |  |  | X |

TABLE 8-continued

Exemplary Combinations of Domains in a synTF Polypeptide or synTF Polypeptide System.

| PRO | IPD | CS | DD | LP | DM | SP | PRO | IPD | CS | DD | LP | DM | SP |
|---|---|---|---|---|---|---|---|---|---|---|---|---|---|
| X | X | X | X | X |   |   |   | X | X |   |   |   | X |
|   |   |   |   |   | X |   | X | X | X |   |   |   | X |
| X |   |   |   |   | X |   |   |   |   | X |   |   | X |
|   | X |   |   |   | X |   |   | X |   | X |   |   | X |
| X | X |   |   |   | X |   |   |   | X | X |   |   | X |
|   | X |   |   |   | X |   | X | X |   | X |   |   | X |
| X |   | X |   |   | X |   |   |   |   | X | X |   | X |
|   | X | X |   |   | X |   | X |   |   | X | X |   | X |
|   | X | X | X |   |   | X | X | X | X |   |   | X | X |
| X | X | X | X |   |   | X |   |   |   | X |   | X | X |
|   |   |   |   | X | X | X |   |   |   | X | X | X | X |
| X |   |   |   | X | X | X |   | X |   | X | X | X | X |
|   | X |   |   | X | X | X | X | X |   | X | X | X | X |
| X | X |   |   | X | X | X |   |   | X | X | X | X | X |
|   | X |   |   | X | X | X | X |   | X | X | X | X | X |
| X |   |   |   | X | X | X |   | X | X | X | X | X | X |
|   | X | X |   | X | X | X | X | X | X |   | X | X | X |
| X | X | X |   | X | X |   |   |   |   | X | X | X | X |
|   |   | X | X | X | X |   | X |   |   | X | X | X | X |
| X |   | X | X | X |   |   | X |   |   | X | X | X | X |
|   | X | X | X | X |   | X | X |   |   | X | X | X | X |
| X | X | X | X | X |   |   |   | X |   | X | X | X | X |
|   | X | X | X | X |   | X |   | X |   | X | X | X | X |
| X | X | X | X |   | X |   |   |   | X | X | X | X | X |
|   |   |   |   |   | X | X | X |   | X | X | X | X | X |
| X |   |   |   |   | X | X |   |   | X | X | X | X | X |
|   | X |   |   |   | X | X | X |   | X | X | X | X | X |
| X | X |   |   |   | X | X |   | X | X | X | X | X | X |
|   |   | X |   |   | X | X | X | X | X | X | X | X | X |
| X |   | X |   |   | X | X |   |   | X | X | X | X | X |
|   | X | X |   |   | X | X | X | X | X | X | X | X | X |

Each exemplary synTF polypeptide shown in Table 8 also comprises a transcriptional effector domain and a DNA-binding domain.
The domains can be in any order.
"PRO" indicates repressible protease.
"IPD" indicates induced proximity domain.
"CS" indicates cytosolic sequestering domain.
"DD" indicates induced degron domain.
"LP" indicates linker peptide.
"DM" indicates detectable marker.
"SP" indicates self-cleaving peptide.

Transcriptional Effector Domain (ED)

Described herein are synTFs comprising a transcriptional effector domain (ED), which can also be referred to herein as an effector domain. In one embodiment of any aspect described herein, the transcriptional effector domain (ED) of the synTF is a transcription activating domain (TA) or a transcription repressor domain (also referred to herein as a transcriptional repressor (TR)). For example, the transcriptional effector domain is selected from the group consisting of a Herpes Simplex Virus Protein 16 (VP16) activation domain; an activation domain consisting of four tandem copies of VP16, a VP64 activation domain; a p65 activation domain of NFkB or functional fragment thereof; an Epstein-Barr virus R transactivator (Rta) activation domain or functional fragment thereof; a tripartite activator consisting of the VP64, the p65, and the Rta activation domains, wherein the tripartite activator is known as a VPR activation domain; a miniVPR; a histone acetyltransferase (HAT) core domain of the human E1A-associated protein p300, known as a p300 HAT core activation domain; a CBP HAT domain; a Krüppel associated box (KRAB) repression domain; KRAB-MeCP2; a DNA (cytosine-5)-methyltransferase 3B (DNMT3B) repressor domain; a HDAC4 domain; an HP1 alpha repression domain; and an EED (Embryonic Ectoderm Development) repressor domain.

In some embodiments of any of the aspects, a synTF polypeptide as described herein (or a synTF polypeptide system collectively) comprises 1, 2, 3, 4, 5, or transcriptional effector domain(s). In some embodiments of any of the aspects, the synTF polypeptide or system comprises one transcriptional effector domain. In embodiments comprising multiple transcriptional effector domains, the multiple transcriptional effector domains can be different individual transcriptional effector domains or multiple copies of the same transcriptional effector domain, or a combination of the foregoing.

In some embodiments of any of the aspects, the transcriptional ED is a transcriptional activator (TA) domain. As used herein, the term "transcriptional activator" domain refers to an effector that increases gene expression. In some embodiments of any of the aspects, the TA is selected from the group consisting of: p65; Rta; miniVPR; full VPR; VP16; VP64; p300; p300 HAT Core; and a CBP HAT domain. See e.g., U.S. Pat. Nos. 10,138,493; 10,590,182; Khalil et al., Cell Volume 150, Issue 3, 3 Aug. 2012, Pages 647-658; Vora et al., Rational design of a compact CRISPR—Cas9 activator for AAV-mediated delivery, bioRxiv 2018 doi.org/10.1101/298620; Chavez et al., Nat Methods. 2015 Apr., 12(4): 326-328; Park et al., Cell. 2019 Jan. 10, 176(1-2): 227-238, e20; Hilton et al., Nature Biotechnology volume In some embodiments of any of the aspects, the TA is p65, or a functional fragment thereof. Transcription factor p65 also known as nuclear factor NF-kappa-B p65 subunit is a protein that in humans is encoded by the RELA gene. In some embodiments of any of the aspects, p65 comprises SEQ ID NO: 69 or a protein having at least 85% sequence identity to SEQ ID NO: 69. In some embodiments of any of the aspects, p65 comprises SEQ ID NO: 117 or a protein having at least 85% sequence identity to SEQ ID NO: 117. In some embodiments of any of the aspects, p65 comprises SEQ ID NO: 118 or a portion of SEQ ID NO: 118, e.g., residues 150-261, 100-261, 200-261, 1-200, 1-50, 1-100, or 50-100 of SEQ ID NO: 118. In some embodiments of any of the aspects, p65 comprises one of SEQ ID NOs: 69, 117-121, 193-197 or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 69, 117-121, 193-197 that maintains its function. In some embodiments of any of the aspects, p65 comprises SEQ ID NO: 120 (p65 100-261) or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to SEQ ID NO: 120 that maintains the same function.

```
SEQ ID NO: 69, p65 (amino acids 361-551 of NFkB)
Activation Domain (191 aa)
DEFPTMVFPSGQISQASALAPAPPQVLPQAPAPAPAPAMVSALAQAPAPV

PVLAPGPPQAVAPPAPKPTQAGEGTLSEALLQLQFDDEDLGALLGNSTDP

AVFTDLASVDNSEFQQLLNQGIPVAPHTTEPMLMEYPEAITRLVTGAQRP

PDPAPAPLGAPGLPNGLLSGDEDFSSIADMDFSALLSQISS

SEQ ID NO: 117, p65 (full sequence, 551 aa),
transcription factor p65 isoform 1 [Homo sapiens],
NCBI Reference Sequence: NP_068810.3
MDELFPLIFPAEPAQASGPYVEIIEQPKQRGMRFRYKCEGRSAGSIPGER

STDTTKTHPTIKINGYTGPGTVRISLVTKDPPHRPHPHELVGKDCRDGFY

EAELCPDRCIHSFQNLGIQCVKKRDLEQAISQRIQTNNNPFQVPIEEQRG

DYDLNAVRLCFQVTVRDPSGRPLRLPPVLSHPIFDNRAPNTAELKICRVN

RNSGSCLGGDEIFLLCDKVQKEDIEVYFTGPGWEARGSFSQADVHRQVAI

VFRTPPYADPSLQAPVRVSMQLRRPSDRELSEPMEFQYLPDTDDRHRIEE

KRKRTYETFKSIMKKSPFSGPTDPRPPPRRIAVPSRSSASVPKPAPQPYP

FTSSLSTINYDEFPTMVFPSGQISQASALAPAPPQVLPQAPAPAPAPAMV

SALAQAPAPVPVLAPGPPQAVAPPAPKPTQAGEGTLSEALLQLQFDDEDL

GALLGNSTDPAVFTDLASVDNSEFQQLLNQGIPVAPHTTEPMLMEYPEAI

TRLVTGAQRPPDPAPAPLGAPGLPNGLLSGDEDFSSIADMDFSALLSQIS

S

SEQ ID NO: 118, p65 1-261 (261 aa)
SQYLPDTDDRHRIEEKRKRTYETFKSIMKKSPFSGPTDPRPPPRRIAVPS

RSSASVPKPAPQPYPFTSSLSTINYDEFPTMVFPSGQISQASALAPAPPQ

VLPQAPAPAPAPAMVSALAQAPAPVPVLAPGPPQAVAPPAPKPTQAGEGT

LSEALLQLQFDDEDLGALLGNSTDPAVFTDLASVDNSEFQQLLNQGIPVA

PHTTEPMLMEYPEAITRLVTGAQRPPDPAPAPLGAPGLPNGLLSGDEDFS

SIADMDFSALL

SEQ ID NO: 119, p65 150-261 (112 aa)
SLSEALLQLQFDDEDLGALLGNSTDPAVFTDLASVDNSEFQQLLNQGIPV

APHTTEPMLMEYPEAITRLVTGAQRPPDPAPAPLGAPGLPNGLLSGDEDF

SSIADMDFSALL

SEQ ID NO: 120, p65 100-261 (162 aa)
SVLPQAPAPAPAPAMVSALAQAPAPVPVLAPGPPQAVAPPAPKPTQAGEG

TLSEALLQLQFDDEDLGALLGNSTDPAVFTDLASVDNSEFQQLLNQGIPV

APHTTEPMLMEYPEAITRLVTGAQRPPDPAPAPLGAPGLPNGLLSGDEDF

SSIADMDFSALL

SEQ ID NO: 121, p65 200-261 (62 aa)
SPHTTEPMLMEYPEAITRLVTGAQRPPDPAPAPLGAPGLPNGLLSGDEDF

SSIADMDFSALL

SEQ ID NO: 193, p65 1-200 (200 aa)
SQYLPDTDDRHRIEEKRKRTYETFKSIMKKSPFSGPTDPRPPPRRIAVPS

RSSASVPKPAPQPYPFTSSLSTINYDEFPTMVFPSGQISQASALAPAPPQ

VLPQAPAPAPAPAMVSALAQAPAPVPVLAPGPPQAVAPPAPKPTQAGEGT

LSEALLQLQFDDEDLGALLGNSTDPAVFTDLASVDNSEFQQLLNQGIPVA

SEQ ID NO: 194, p65 1-150 (150 aa)
SQYLPDTDDRHRIEEKRKRTYETFKSIMKKSPFSGPTDPRPPPRRIAVPS

RSSASVPKPAPQPYPFTSSLSTINYDEFPTMVFPSGQISQASALAPAPPQ

VLPQAPAPAPAPAMVSALAQAPAPVPVLAPGPPQAVAPPAPKPTQAGEGT

SEQ ID NO: 195, p65 1-100 (100 aa)
SQYLPDTDDRHRIEEKRKRTYETFKSIMKKSPFSGPTDPRPPPRRIAVPS

RSSASVPKPAPQPYPFTSSLSTINYDEFPTMVFPSGQISQASALAPAPPQ

SEQ ID NO: 196, p65 50-150 (101 aa)
SRSSASVPKPAPQPYPFTSSLSTINYDEFPTMVFPSGQISQASALAPAPP

QVLPQAPAPAPAPAMVSALAQAPAPVPVLAPGPPQAVAPPAPKPTQAGEG

T

SEQ ID NO: 197, p65 143-261 (119 aa)
PTQAGEGTLSEALLQLQFDDEDLGALLGNSTDPAVFTDLASVDNSEFQQL

LNQGIPVAPHTTEPMLMEYPEAITRLVTGAQRPPDPAPAPLGAPGLPNGL

LSGDEDFSSIADMDFSALL
```

In some embodiments of any of the aspects, the TA is Rta, or a functional fragment thereof. Rta is an Epstein-Barr virus R transactivator (Rta) activation domain. In some embodiments of any of the aspects, Rta comprises SEQ ID NO: 198 or a protein having at least 85% sequence identity to SEQ ID NO: 198. In some embodiments of any of the aspects, Rta comprises a portion of SEQ ID NO: 198, e.g., residues 75-190, 125-190, 50-175, 75-175, 100-175, or 125-175 of SEQ ID NO: 198. In some embodiments of any of the aspects, Rta comprises one of SEQ ID NOs: 198-204 or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 198-204 that maintains its function. In some embodiments of any of the aspects, Rta comprises SEQ ID NO: 200 (Rta 125-190) or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to SEQ ID NO: 200 that maintains the same function.

SEQ ID NO: 198, Rta (full sequence, 1-190; 190 aa)
RDSREGMFLPKPEAGSAISDVFEGREVCQPKRIRPFHPPGSPWANRPLPA

SLAPTPTGPVHEPVGSLTPAPVPQPLDPAPAVTPEASHLLEDPDEETSQA

VKALREMADTVIPQKEEAAICGQMDLSHPPPRGHLDELTTTLESMTEDLN

LDSPLTPELNEILDTFLNDECLLHAMHISTGLSIFDTSLF

SEQ ID NO: 199, Rta (75-190, 116 aa)
PLDPAPAVTPEASHLLEDPDEETSQAVKALREMADTVIPQKEEAAICGQM

DLSHPPPRGHLDELTTTLESMTEDLNLDSPLTPELNEILDTFLNDECLLH

AMHISTGLSIFDTSLF

SEQ ID NO: 200, Rta (125-190, 66 aa)
DLSHPPPRGHLDELTTTLESMTEDLNLDSPLTPELNEILDTFLNDECLLH

AMHISTGLSIFDTSLF

SEQ ID NO: 201, Rta (50-175, 126 aa)
SSLAPTPTGPVHEPVGSLTPAPVPQPLDPAPAVTPEASHLLEDPDEETSQ

AVKALREMADTVIPQKEEAAICGQMDLSHPPPRGHLDELTTTLESMTEDL

NLDSPLTPELNEILDTFLNDECLLHA

SEQ ID NO: 202, Rta (75-175, 101 aa)
PLDPAPAVTPEASHLLEDPDEETSQAVKALREMADTVIPQKEEAAICGQM

DLSHPPPRGHLDELTTTLESMTEDLNLDSPLTPELNEILDTFLNDECLLH

A

SEQ ID NO: 203, Rta (100-175, 76 aa)
SVKALREMADTVIPQKEEAAICGQMDLSHPPPRGHLDELTTTLESMTEDL

NLDSPLTPELNEILDTFLNDECLLHA

SEQ ID NO: 204, Rta (125-175, 51 aa)
DLSHPPPRGHLDELTTTLESMTEDLNLDSPLTPELNEILDTFLNDECLLH

A

In some embodiments of any of the aspects, the TA is VPR, or a functional fragment thereof. VPR is a tripartite activator consisting of the VP64, the p65, and the Rta activation domains. In some embodiments of any of the aspects, VPR comprises VP64 (e.g., SEQ ID NO: 208), p65 (e.g., any one of SEQ ID NOs: 69, 117-121 or 193-197 or a polypeptide with at least 85% sequence identity to any one of SEQ ID NOs: 69, 117-121 or 193-197 that maintains the same function), and Rta (e.g., any one of SEQ ID NOs: 198-204 or a polypeptide with at least 85% sequence identity to any one of SEQ ID NOs: 198-204 that maintains the same function). In some embodiments of any of the aspects, VPR comprises one of SEQ ID NOs: 205, 206, or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 205 or 206, that maintains its function.

SEQ ID NO: 205, miniVPR, comprising the p65 (100-261aa; SEQ ID NO: 120) truncation and the RTA (125-190aa; SEQ ID NO: 200) truncation; bold text indicates VP64 (SEQ ID NO: 208); italicized text indicates SV40 NLS (SEQ ID NO: 65); bold italicized text indicates p65 (100-261aa; SEQ ID NO: 120); double underlined text indicates RTA (125-190aa; SEQ ID NO: 200).
GRADALDDFDLDMLGSDALDDFDLDMLGSDALDDFDLDMLGSDALDDFDL

DMLINSRSSGS*PKKKRKV*GSGGGSGGSGS

*VLPQAPAPAPAPAMVSALAQA PAPVPVLAPGPPQAVAPPAPKPTQAG*

*EGTLSEALLQLQFDDEDL GALLGNSTDPAVFTDLASVD*

*NSEFQQLLNQGIPVAPHTTEPMLEY PEAITRLVTGAQRPPDPAPAP*

*LGAPGLPNGLLSGDEDFSSIADMDFSALL*

SGGGSGGSGS<u>DLSHPPPRGHLDELTTTLESMTEDLNLDSPLTPELNEILD</u>

<u>TFLNDECLLHAMHISTGLSIFDTSLF</u>

SEQ ID NO: 206, full VPR; bold text indicates VP64 (SEQ ID NO: 208); italicized text indicates SV40 NLS (SEQ ID NO: 65); bold italicized text indicates p65 (SEQ ID NO: 118); double underlined text indicates RTA (SEQ ID NO: 198).
GRADALDDFDLDMLGSDALDDFDLDMLGSDALDDFDLDMLGSDALDDFDL

DMLINSRSSGS*PKKKRKV* *GSQYLPDTDDRHRIEEKRKRTYETF*

*KSIMKKSPFSGPTDPRPPPRRIAVPSRSSASVPK*

*PAPQPYPFTSSLSTINYDEFPTMVFPSGQISQAS*

*ALAPAPPQVLPQAPAPAPAPAMVSALAQAPAP*

*VPVLAPGPPQAVAPPAPKPTQAGEGTLSE*

*ALLQLQFDDEDLGALLGNSTDPAVFTDLASVDNSE*

*FQQLLNQGIPVAPHTTEPML MEYPEAITRLVTGAQRPPDPA*

*PAPLGAPGLPNGLLSGDEDFSSIA DMDFSALL* GSGSGS<u>RDSREGM</u>

<u>FLPKPEAGSAISDVFEGREVCQPKRIRPFHPPGSPWANRPLPASLAPTPT</u>

<u>GPVHEPVGSLTPAPVPQPLDPAPAVTPEASHLLEDPDEETSQAVKALREM</u>

<u>ADTVIPQKEEAAICGQMDLSHPPPRGHLDELTTTLESMTEDLNLDSPLTP</u>

<u>ELNEILDTFLNDECLLHAMHISTGLSIFDTSLF</u>

In some embodiments of any of the aspects, the TA comprises the Herpes Simplex Virus Protein 16 (VP16) activation domain. In some embodiments of any of the aspects, the TA comprises the VP64 activation domain, which comprises four tandem copies of VP16. In some embodiments of any of the aspects, the TA comprises one of SEQ ID NOs: 207, 208, or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 207 or 208, that maintains its function.

VP16 (11 aa)
SEQ ID NO: 207
DALDDFDLDML,

VP64 (53 aa), with the
VP16 domain indicated by bold text,
SEQ ID NO: 208
GRADALDDFDLDMLGSDALDDFDLDMLGSDA

LDDFDLDMLGSDALDDFDLDML,

In some embodiments of any of the aspects, the TA comprises p300 or a functional fragment thereof. The adenovirus E1A-associated cellular p300 transcriptional co-activator protein functions as histone acetyltransferase that regulates transcription via chromatin remodeling. In some embodiments of any of the aspects, p300 comprises SEQ ID NO: 209 or a protein having at least 85% sequence identity to SEQ ID NO: 209. In some embodiments of any of the aspects, p300 comprises a portion of SEQ ID NO: 209, e.g., residues 1048-1664 of SEQ ID NO: 209. In some embodiments of any of the aspects, the TA comprises the p300 HAT Core activation domain. In some embodiments of any of the aspects, p300 comprises SEQ ID NO: 210 or a protein having at least 85% sequence identity to SEQ ID NO: 210. In some embodiments of any of the aspects, the TA comprises one of SEQ ID NOs: 209, 210, or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 209 or 210, that maintains its function.

SEQ ID NO: 209, human acetyltransferase p300 (2414 aa), bold text indicates the core activation domain
MAENVVEPGPPSAKRPKLSSPALSASASDGTDFGSLFDLEHDLPDELINS

TELGLTNGGDINQLQTSLGMVQDAASKHKQLSELLRSGSSPNLNMGVGGP

GQVMASQAQQSSPGLGLINSMVKSPMTQAGLTSPNMGMGTSGPNQGPTQS

TGMMNSPVNQPAMGMNTGMNAGMNPGMLAAGNGQGIMPNQVMNGSIGAGR

GRQNMQYPNPGMGSAGNLLTEPLQQGSPQMGGQTGLRGPQPLKMGMMNNP

NPYGSPYTQNPGQQIGASGLGLQIQTKTVLSNNLSPFAMDKKAVPGGGMP

NMGQQPAPQVQQPGLVTPVAQGMGSGAHTADPEKRKLIQQQLVLLLHAHK

CQRREQANGEVRQCNLPHCRTMKNVLNHMTHCQSGKSCQVAHCASSRQII

SHWKNCTRHDCPVCLPLKNAGDKRNQQPILTGAPVGLGNPSSLGVGQQSA

PNLSTVSQIDPSSIERAYAALGLPYQVNQMPTQPQVQAKNQQNQQPGQSP

QGMRPMSNMSASPMGVNGGVGVQTPSLLSDSMLHSAINSQNPMMSENASV

PSLGPMPTAAQPSTTGIRKQWHEDITQDLRNHLVHKLVQAIFPTPDPAAL

KDRRMENLVAYARKVEGDMYESANNRAEYYHLLAEKIYKIQKELEEKRRT

RLQKQNMLPNAAGMVPVSMNPGPNMGQPQPGMTSNGPLPDPSMIRGSVPN

QMMPRITPQSGLNQFGQMSMAQPPIVPRQTPPLQHHGQLAQPGALNPPMG

YGPRMQQPSNQGQFLPQTQFPSQGMNVTNIPLAPSSGQAPVSQAQMSSSS

CPVNSPIMPPGSQGSHIHCPQLPQPALHQNSPSPVPSRTPTPHHTPPSIG

AQQPPATTIPAPVPTPPAMPPGPQSQALHPPPRQTPTPPTTQLPQQVQPS

LPAAPSADQPQQQPRSQQSTAASVPTPTAPLLPPQPATPLSQPAVSIEGQ

VSNPPSTSSTEVNSQAIAEKQPSQEVKMEAKMEVDQPEPADTQPEDISES

KVEDCKMESTETEERSTELKTEIKEEEDQPSTSATQSSPAPGQSKKKIFK

PEELRQALMPTLEALYRQDPESLPFRQPVDPQLLGIPDYFDIVKSPMDLS

TIKRKLDTGQYQEPWQYVDDIWLMFNNAWLYNRKTSRVYKYCSKLSEVFE

QEIDPVMQSLGYCCGRKLEFSPQTLCCYGKQLCTIPRDATYYSYQNRYHF

CEKCFNEIQGESVSLGDDPSQPQTTINKEQFSKRKNDTLDPELFVECTEC

GRKMHQICVLHHEIIWPAGFVCDGCLKKSARTRKENKFSAKRLPSTRLGT

FLENRVNDFLRRQNHPESGEVTVRVVHASDKTVEVKPGMKARFVDSGEMA

ESFPYRTKALFAFEEIDGVDLCFFGMHVQEYGSDCPPPNQRRVYISYLDS

VHFFRPKCLRTAVYHEILIGYLEYVKKLGYTTGHIWACPPSEGDDYIFHC

HPPDQKIPKPKRLQEWYKKMLDKAVSERIVHDYKDIFKQATEDRLTSAKE

LPYFEGDFWPNVLEESIKELEQEEEERKREENTSNESTDVTKGDSKNAKK

KNNKKTSKNKSSLSRGNKKKPGMPNVSNDLSQKLYATMEKHKEVFFVIRL

IAGPAANSLPPIVDPDPLIPCDLMDGRDAFLTLARDKHLEFSSLRRAQWS

TMCMLVELHTQSQDRFVYTCNECKHHVETRWHCTVCEDYDLCITCYNTKN

HDHKMEKLGLGLDDESNNQQAAATQSPGDSRRLSIQRCIQSLVHACQCRN

ANCSLPSCQKMKRVVQHTKGCKRKTNGGCPICKQLIALCCYHAKHCQENK

CPVPFCLNIKQKLRQQQLQHRLQQAQMLRRRMASMQRTGVVGQQQGLPSP

TPATPTTPTGQQPTTPQTPQPTSQPQPTPPNSMPPYLPRTQAAGPVSQGK

AAGQVTPPTPPQTAQPPLPGPPPAAVEMAMQIQRAAETQRQMAHVQIFQR

PIQHQMPPMTPMAPMGMNPPPMTRGPSGHLEPGMGPTGMQQQPPWSQGGL

PQPQQLQSGMPRPAMMSVAQHGQPLNMAPQPGLGQVGISPLKPGTVSQQA

LQNLLRTLRSPSSPLQQQQVLSILHANPQLLAAFIKQRAAKYANSNPQPI

PGQPGMPQGQPGLQPPTMPGQQGVHSNPAMQNMNPMQAGVQRAGLPQQQP

QQQLQPPMGGMSPQAQQMNMNHNTMPSQFRDILRRQQMMQQQQQQGAGPG

IGPGMANHNQFQQPQGVGYPPQQQQRMQHHMQQMQQGNMGQIGQLPQALG

AEAGASLQAYQQRLLQQQMGSPVQPNPMSPQQHMLPNQAQSPHLQGQQIP

NSLSNQVRSPQPVPSPRPQSQPPHSSPSPRMQPQPSPHHVSPQTSSPHPG

LVAAQANPMEQGHFASPDQNSMLSQLASNPGMANLHGASATDLGLSTDNS

DLNSNLSQSTLDIH

SEQ ID NO: 210, p300 HAT Core activation domain
(617 aa)
IFKPEELRQALMPTLEALYRQDPESLPFRQPVDPQLLGIPDYFDIVKSPM

DLSTIKRKLDTGQYQEPWQYVDDIWLMFNNAWLYNRKTSRVYKYCSKLSE

VFEQEIDPVMQSLGYCCGRKLEFSPQTLCCYGKQLCTIPRDATYYSYQNR

YHFCEKCFNEIQGESVSLGDDPSQPQTTINKEQFSKRKNDTLDPELFVEC

TECGRKMHQICVLHHEIIWPAGFVCDGCLKKSARTRKENKFSAKRLPSTR

LGTFLENRVNDFLRRQNHPESGEVTVRVVHASDKTVEVKPGMKARFVDSG

EMAESFPYRTKALFAFEEIDGVDLCFFGMHVQEYGSDCPPPNQRRVYISY

LDSVHFFRPKCLRTAVYHEILIGYLEYVKKLGYTTGHIWACPPSEGDDYI

FHCHPPDQKIPKPKRLQEWYKKMLDKAVSERIVHDYKDIFKQATEDRLTS

AKELPYFEGDFWPNVLEESIKELEQEEEERKREENTSNESTDVTKGDSKN

-continued

```
AKKKNNKKTSKNKSSLSRGNKKKPGMPNVSNDLSQKLYATMEKHKEVFFV

IRLIAGPAANSLPPIVDPDPLIPCDLMDGRDAFLTLARDKHLEFSSLRRA

QWSTMCMLVELHTQSQD
```

In some embodiments of any of the aspects, the TA comprises CBP or a functional fragment thereof. CBP (CREB (Cyclic AMP-Responsive Element-Binding Protein) Binding Protein; CREBBP) is involved in the transcriptional coactivation of many different transcription factors and has intrinsic histone acetyltransferase activity. In some embodiments of any of the aspects, CBP is derived from *Homo sapiens, Drosophila melanogaster*, or any other organism expressing a homologous CBP protein. In some embodiments of any of the aspects, the TA comprises the CBP HAT Core activation domain. In some embodiments of any of the aspects, the TA comprises one of SEQ ID NOs: 211-213, or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 211-213, that maintains its function.

```
SEQ ID NO: 211, Homo sapiens CBP, histone acetyl-
transferase (HAT)-domain; residues 1342-1649 of
CREB-binding protein isoform a [Homo sapiens],
NCBI Reference Sequence: NP_004371.2; residues
1304-1611 of CREB-binding protein isoform b [Homo
sapiens], NCBI Reference Sequence: NP_001073315.1.
VNKFLRRQNHPEAGEVFVRVVASSDKTVEVKPGMKSRFVDSGEMSESFP

YRTKALFAFEEIDGVDVCFFGMHVQEYGSDCPPPNTRRVYISYLDSIHF

FRPRCLRTAVYHEILIGYLEYVKKLGYVTGHIWACPPSEGDDYIFHCHP

PDQKIPKPKRLQEWYKKMLDKAFAERIIHDYKDIFKQATEDRLTSAKEL

PYFEGDFWPNVLEESIKELEQEEEERKKEESTAASETTEGSQGDSKNAK

KKNNKKTNKNKSSISRANKKKPSMPNVSNDLSQKLYATMEKHKEVFFVI

HLHAGPVINTLPPI

SEQ ID NO: 212, residues 1954-2267 of nejire,
isoform E [Drosophila melanogaster], NCBI
Reference Sequence: NP_001259387.1, HAT_KAT11,
Histone acetylation protein
VNNFLKKKEAGAGEVHIRVVSSSDKCVEVKPGMRRRFVEQGEMMNEFPY

RAKALFAFEEVDGIDVCFFGMHVQEYGSECPAPNTRRVYIAYLDSVHFF

RPRQYRTAVYHEILLGYMDYVKQLGYTMAHIWACPPSEGDDYIFHCHPT

DQKIPKPKRLQEWYKKMLDKGMIERIIQDYKDILKQAMEDKLGSAAELP

YFEGDFWPNVLEESIKELDQEEEEKRKQAEAAEAAAAANLFSIEENEVS

GDGKKKGQKKAKKSNKSKAAQRKNSKKSNEHQSGNDLSTKIYATMEKHK

EVFFVIRLHSAQSAASLAPI

SEQ ID NO: 213, aa 1696-2329 from Drosophila CBP
(nejire), NCBI Reference Sequence: NP 001259387.1,
including the bromodomain, PHD domain, and HAT
domain
NGKYSDPWEYVDDVWLMFDNAWLYNRKTSRVYRYCTKLSEVFEAEIDPV

MQALGYCCGRKYTFNPQVLCCYGKQLCTIPRDAKYYSYQNRYTYCQKCF

NDIQGDTVTLGDDPLQSQTQIKKDQFKEMKNDHLELEPFVNCQECGRKQ

HQICVLWLDSIWPGGFVCDNCLKKKNSKRKENKFNAKRLPTTKLGVYIE

TRVNNFLKKKEAGAGEVHIRVVSSSDKCVEVKPGMRRRFVEQGEMMNEF

PYRAKALFAFEEVDGIDVCFFGMHVQEYGSECPAPNTRRVYIAYLDSVH

FFRPRQYRTAVYHEILLGYMDYVKQLGYTMAHIWACPPSEGDDYIFHCH

PTDQKIPKPKRLQEWYKKMLDKGMIERIIQDYKDILKQAMEDKLGSAAE

LPYFEGDFWPNVLEESIKELDQEEEEKRKQAEAAEAAAAANLFSIEENE

VSGDGKKKGQKKAKKSNKSKAAQRKNSKKSNEHQSGNDLSTKIYATMEK

HKEVFFVIRLHSAQSAASLAPIQDPDPLLTCDLMDGRDAFLTLARDKHF

EFSSLRRAQFSTLSMLYELHNQGQDKFVYTCNHCKTAVETRYHCTVCDD

FDLCIVCKEKVGHQHKMEKLGFDIDDGSALADHKQANPQEARKQSI.
```

In some embodiments of any of the aspects, the transcriptional ED is a transcriptional repressor (TR) domain. As used herein, the term "transcriptional repressor" domain refers to an effector that decreases gene expression. In some embodiments of any of the aspects, the TR is selected from the group consisting of: KRAB; KRAB-MeCP2; Hp1a; DNMT3B; EED; and HDAC4. See e.g., U.S. Pat. Nos. 10,138,493; 10,590,182; Khalil et al., Cell Volume 150, Issue 3, 3 Aug. 2012, Pages 647-658; Park et al., Cell. 2019 Jan. 10, 176(1-2):227-238, e20; Yeo et al., Nature Methods volume 15, pages 611-616(2018); Bintu et al., Science. 2016 Feb. 12; 351(6274): 720-724; the contents of each of which are incorporated herein by reference in their entireties.

In some embodiments of any of the aspects, the TR comprises KRAB, or a functional fragment thereof. The Krüppel associated box (KRAB) domain is a category of transcriptional repression domains present in approximately 400 human zinc finger protein-based transcription factors (KRAB zinc finger proteins), and it associates with other chromatin regulators that write or read H3K9me3. In some embodiments of any of the aspects, the TR comprises KRAB-MeCP2, a bipartite repressor domain. In some embodiments of any of the aspects, KRAB domain comprises one of SEQ ID NOs: 72, 97, 214-215, or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 72, 97, or 214-215 that maintains its function. In some embodiments of any of the aspects, the TR comprises the transcription repression domain (TRD) domain of MeCP2, or a functional fragment thereof. In some embodiments of any of the aspects, the transcription repression domain (TRD) domain of MeCP2 comprises SEQ ID NO: 216 or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to SEQ ID NO: 216, that maintains its function.

```
SEQ ID NO: 72: KRAB repressor domain (96 aa)
DAKSLTAWSRTLVTFKDVFVDFTREEWKLLDTAQQILYRNVMLENYKNLV

SLGYQLTKPDVILRLEKGEEPWLVEREIHQETHPDSETAFEIKSSV

SEQ ID NO: 97: KRAB repressor domain (65 aa)
LAVSVTFEDVAVLFTRDEWKKLDLSQRSLYREVMLENYSNLASMAGFLFT

KPKVISLLQQGEDPW
```

-continued

SEQ ID NO: 214, KRAB-MeCP2 (382 aa), comprising
KRAB domain (bold text), glycine-serine rich
linker (unformatted text) and transcription
repression domain (TRD) domain of MeCP2
(italicized text).
MDAKSLTAWSRTLVTFKDVFVDFTREEWKLLDTAQQIVYRNVMLENYKNL

VSLGYQLTKPDVILRLEKGEEPWLVSGGGSGGSGS*SPKKKRKVEASVQVK*

*RVLEKSPGKLLVKMPFQASPGGKGEGGGATTSAQVMVIKRPGRKRKAEAD*

*PQAIPKKRGRKPGSVVAAAAAEAKKKAVKESSIRSVQETVLPIKKRKTRE*

*TVSIEVKEVVKPLLVSTLGEKSGKGLKTCKSPGRKSKESSPKGRSSSASS*

*PPKKEHHHHHHHAESPKAPMPLLPPPPPPEPQSSEDPISPPEPQDLSSSI*

*CKEEKMPRAGSLESDGCPKEPAKTQPMVAAAATTTTTTTTVAEKYKHRG*

*EGERKDIVSSSMPRPNREEPVDSRTPVTERVS*

SEQ ID NO: 215, KRAB repressor domain (74 aa)
DAKSLTAWSRTLVTFKDVFVDFTREEWKLLDTAQQIVYRNVMLENYKNLV

SLGYQLTKPDVILRLEKGEEPWLV

SEQ ID NO: 216, transcription repression domain
(TRD) domain of MeCP2 (296 aa)
PKKKRKVEASVQVKRVLEKSPGKLLVKMPFQASPGGKGEGGGATTSAQVM

VIKRPGRKRKAEADPQAIPKKRGRKPGSVVAAAAAEAKKKAVKESSIRSV

QETVLPIKKRKTRETVSIEVKEVVKPLLVSTLGEKSGKGLKTCKSPGRKS

KESSPKGRSSSASSPPKKEHHHHHHHAESPKAPMPLLPPPPPPEPQSSED

PISPPEPQDLSSSICKEEKMPRAGSLESDGCPKEPAKTQPMVAAAATTTT

TTTTTVAEKYKHRGEGERKDIVSSSMPRPNREEPVDSRTPVTERVS

In some embodiments of any of the aspects, the TR comprises a Hp1a repressor domain, or a functional fragment thereof. Heterochromatin protein 1 (HP1a in *Drosophila*) is a conserved eukaryotic chromosomal protein that is prominently associated with pericentric heterochromatin and mediates the concomitant gene silencing. HP1a binds H3K9me2/3 through its chromo domain, and binds SU(VAR)3-9, one of the histone methyltransferases that methylates histone H3 on K9, through its chromo shadow domain. In some embodiments of any of the aspects, the Hp1a repressor domain comprises SEQ ID NO: 98 or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to SEQ ID NO: 98, that maintains its function.

SEQ ID NO: 98: Hp 1a repressor domain (190 aa)
GKKTKRTADSSSSEDEEEYVVEKVLDRRVVKGQVEYLLKWKGFSEEHNTW

EPEKNLDCPELISEFMKKYKKMKEGENNKPREKSESNKRKSNFSNSADDI

KSKKKREQSNDIARGFERGLEPEKIIGATDSCGDLMFLMKWKDTDEADLV

LAKEANVKCPQIVIAFYEERLTWHAYPEDAENKEKETAKS

In some embodiments of any of the aspects, the TR comprises an EED repressor domain, or a functional fragment thereof. EED (Embryonic Ectoderm Development) functions as part of the Polycomb repressive complex 2 (PRC2), which methylates histone H3 at lysine 27 (H3K27me3). Polycomb family members form multimeric protein complexes, which are involved in maintaining the transcriptional repressive state of genes over successive cell generations. In some embodiments of any of the aspects, the EED repressor domain comprises SEQ ID NO: 99 or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to SEQ ID NO: 99, that maintains its function.

SEQ ID NO: 99: EED repressor domain (440 aa)
SEREVSTAPAGTDMPAAKKQKLSSDENSNPDLSGDENDDAVSIESGTNTE

RPDTPTNTPNAPGRKSWGKGKWKSKKCKYSFKCVNSLKEDHNQPLFGVQF

NWHSKEGDPLVFATVGSNRVTLYECHSQGEIRLLQSYVDADADENFYTCA

WTYDSNTSHPLLAVAGSRGIIRIINPITMQCIKHYVGHGNAINELKFHPR

DPNLLLSVSKDHALRLWNIQTDTLVAIFGGVEGHRDEVLSADYDLLGEKI

MSCGMDHSLKLWRINSKRMMNAIKESYDYNPNKTNRPFISQKIHFPDFST

RDIHRNYVDCVRWLGDLILSKSCENAIVCWKPGKMEDDIDKIKPSESNVT

ILGRFDYSQCDIWYMRFSMDFWQKMLALGNQVGKLYVWDLEVEDPHKAKC

TTLTFIHKCGAAIRQTSFSRDSSILIAVCDDASIWRWDRLR

In some embodiments of any of the aspects, the TR comprises a DNA (cytosine-5)-methyltransferase 3B (DNMT3B) repressor domain, or a functional fragment thereof. DNMT3B is involved in CpG methylation, which is an epigenetic modification that is important for embryonic development, imprinting, and X-chromosome inactivation. In some embodiments of any of the aspects, the DNMT3B repressor domain comprises SEQ ID NO: 217 or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to SEQ ID NO: 217, that maintains its function.

DNMT3B repressor domain (792 aa), Uniprot
identifier Q9UBC3-5, DNM3B_HUMAN Isoform 5
of DNA (cytosine-5)-methyltransferase
                                    SEQ ID NO: 217
MKGDTRHLNGEEDAGGREDSILVNGACSDQSSDSPPILEAIRTPEIRGRR

SSSRLSKREVSSLLSYTQDLTGDGDGEDGDGSDTPVMPKLFRETRTRSES

PAVRTRNNNSVSSRERHRPSPRSTRGRQGRNHVDESPVEFPATRSLRRRA

TASAGTPWPSPPSSYLTIDLTDDTEDTHGTPQSSSTPYARLAQDSQQGGM

ESPQVEADSGDGDSSEYQDGKEFGIGDLVWGKIKGFSWWPAMVVSWKATS

KRQAMSGMRWVQWFGDGKFSEVSADKLVALGLFSQHFNLATFNKLVSYRK

AMYHALEKARVRAGKTFPSSPGDSLEDQLKPMLEWAHGGFKPTGIEGLKP

NNTQPENKTRRRTADDSATSDYCPAPKRLKTNCYNNGKDRGDEDQSREQM

ASDVANNKSSLEDGCLSCGRKNPVSFHPLFEGGLCQTCRDRFLELFYMYD

DDGYQSYCTVCCEGRELLLCSNTSCCRCFCVECLEVLVGTGTAAEAKLQE

PWSCYMCLPQRCHGVLRRRKDWNVRLQAFFTSDTGLEYEAPKLYPAIPAA

RRRPIRVLSLFDGIATGYLVLKELGIKVGKYVASEVCEESIAVGTVKHEG

NIKYVNDVRNITKKNIEEWGPFDLVIGGSPCNDLSNVNPARKGLYEGTGR

LFFEFYHLLNYSRPKEGDDRPFFWMFENVVAMKVGDKRDISRFLECNPVM

IDAIKVSAAHRARYFWGNLPGMNRPVIASKNDKLELQDCLEYNRIAKDLW

LSCALHRRVQHGPWCPPEAAGKVLERACHPTPLRPSEGLLCM,

In some embodiments of any of the aspects, the TR comprises a histone deacetylase 4 (HDAC4) repressor domain, or a functional fragment thereof. HDAC4 removes acetyl groups from histones H3 and H4. In some embodiments of any of the aspects, the HDAC4 repressor domain comprises SEQ ID NO: 218 or a polypeptide comprising a sequence that is at least 60%, at least 65%, at least 70%, at least 75%, at least 80%, at least 85%, at least 90%, at least 95%, at least 96%, at least 97%, at least 98%, or at least 99% identical to SEQ ID NO: 218, that maintains its function.

a HDAC4 domain, GenBank: AAD29046.1 (1084 aa)
SEQ ID NO: 218
MSSQSHPDGLSGRDQPVELLNPARVNHMPSTVDVATALPLQVAPSAVPMD

LRLDHQFSLPVAEPALREQQLQQELLALKQKQQIQRQILIAEFQRQHEQL

SRQHEAQLHEHIKQQQEMLAMKHQQELLEHQRKLERHRQEQELEKQHREQ

KLQQLKNKEKGKESAVASTEVKMKLQEFVLNKKKALAHRNLNHCISSDPR

YWYGKTQHSSLDQSSPPQSGVSTSYNHPVLGMYDAKDDFPLRKTASEPNL

KLRSRLKQKVAERRSSPLLRRKDGPVVTALKKRPLDVTDSACSSAPGSGP

SSPNNSSGSVSAENGIAPAVPSIPAETSLAHRLVAREGSAAPLPLYTSPS

LPNITLGLPATGPSAGTAGQQDTERLTLPALQQRLSLFPGTHLTPYLSTS

PLERDGGAAHSPLLQHMVLLEQPPAQAPLVTGLGALPLHAQSLVGADRVS

PSIHKLRQHRPLGRTQSAPLPQNAQALQHLVIQQQHQQFLEKHKQQFQQQ

QLQMNKIIPKPSEPARQPESHPEETEEELREHQALLDEPYLDRLPGQKEA

HAQAGVQVKQEPIESDEEEAEPPREVEPGQRQPSEQELLFRQQALLLEQQ

RIHQLRNYQASMEAAGIPVSFGGHRPLSRAQSSPASATFPVSVQEPPTKP

RFTTGLVYDTLMLKHQCTCGSSSSHPEHAGRIQSIWSRLQETGLRGKCEC

IRGRKATLEELQTVHSEAHTLLYGTNPLNRQKLDSKKLLGSLASVFVRLP

CGGVGVDSDTIWNEVHSAGAARLAVGCVVELVFKVATGELKNGFAVVRPP

GHHAEESTPMGFCYFNSVAVAAKLLQQRLSVSKILIVDWDVHHFIGNGTQ

QAFYSDPSVLYMSLHRYDDGNFFPGSGAPDEVGTGPGVGFNVNMAFTGGL

DPPMGDAEYLAAFRTVVMPIASEFAPDVVLVSSGFDAVEGHPTPLGGYNL

SARCFGYLTKQLMGLAGGRIVLALEGGHDLTAICDASEACVSALLGNELD

PLPEKVLQQRPNANAVRSMEKVMEIHSKYWRCLQRTTSTAGRSLIEAQTC

ENEEAETVTAMASLSVGVKPAEKRPDEEPMEEEPPL,

In another embodiment of any aspect described herein, in the synTF described or the ZF-containing fusion protein described herein, the transcriptional effector domain is an epigenetic effector domain. For example, at least one ZF protein domain is fused to one or more chromatin regulating enzymes that (1) catalyze chemical modifications of DNA or histone residues (e.g. DNA methyltransferases, histone methyltransferases, histone acetyltransferases) or (2) remove chemical modifications (e.g. DNA demethylases, DNA di-oxygenases, DNA hydroxylases, histone demethylases, histone deacetylases). For example, a DNA methyltransferase DNMT (DNMT1, DNMT3) catalyzes the transfer of methyl group to cytosine, which typically results in transcriptional repression through the recruitment of repressive regulatory proteins. Another example is CBP/p300 histone acetyltransferase, which is typically associated with transcriptional activation through the interactions with multiple transcription factors. Related epigenetic effector domains associated with the deposition of biochemical marks on DNA or histone residue(s) include HAT1, GCN5, PCAF, MLL, SET, DOT1, SUV39H, G9a, KAT2A/B and EZH1/2. Related epigenetic effector domains associated with the removal of biochemical marks from DNA or histone residue(s) include TET1/2, SIRT family, LSD1, and KDM family.

DNA-Binding Domain

Described herein are synTFs comprising at least one DNA-binding domain (DBD). In some embodiments of any of the aspects, a synTF polypeptide as described herein (or a synTF polypeptide system collectively) comprises 1, 2, 3, 4, 5, or more DBD(s). In some embodiments of any of the aspects, the synTF polypeptide or system comprises one DBD. In embodiments comprising multiple DBDs, the multiple DBDs can be different individual DBDs or multiple copies of the same DBDs, or a combination of the foregoing.

In some embodiments of any of the aspects, the at least one DBD is an engineered zinc finger (ZF) binding domain. A zinc finger (ZF) is a finger-shaped fold in a protein that permits it to interact with nucleic acid sequences such as DNA and RNA. Such a fold is well known in the art. The fold is created by the binding of specific amino acids in the protein to a zinc atom. Zinc-finger containing proteins (also known as ZF proteins) can regulate the expression of genes as well as nucleic acid recognition, reverse transcription and virus assembly.

A ZF is a relatively small polypeptide domain comprising approximately 30 amino acids, which folds to form an α-helix adjacent an antiparallel β-sheet (known as a ββα-fold). The fold is stabilized by the co-ordination of a zinc ion between four largely invariant (depending on zinc finger framework type) Cys and/or His residues, as described further below. Natural zinc finger domains have been well studied and described in the literature, see for example, Miller et al., (1985) EMBO J. 4: 1609-1614; Berg (1988) Proc. Natl. Acad. Sci. USA 85: 99-102; and Lee et al., (1989) Science 245: 635-637. A ZF domain recognizes and binds to a nucleic acid triplet, or an overlapping quadruplet (as explained below), in a double-stranded DNA target sequence. However, ZFs are also known to bind RNA and proteins (Clemens, K. R. et al. (1993) Science 260: 530-533; Bogenhagen, D. F. (1993) Mol. Cell. Biol. 13: 5149-5158; Searles, M. A. et al. (2000) J. Mol. Biol. 301: 47-60; Mackay, J. P. & Crossley, M. (1998) Trends Biochem. Sci. 23: 1-4).

In one embodiment, as used herein, the term "zinc finger" (ZF) or "zinc finger motif" (ZF motif) or "zinc finger domain" (ZF domain) refers to an individual "finger", which comprises a beta-beta-alpha (ββα)-protein fold stabilized by a zinc ion as described elsewhere herein. The Zn-coordinated ββα protein fold produces a finger-like protrusion, a "finger." Each ZF motif typically includes approximately 30 amino acids. The term "motif" as used herein refers to a structural motif. The ZF motif is a supersecondary structure having the ββα-fold that stabilized by a zinc ion.

In one embodiment, the term "ZF motif" according to its ordinary usage in the art, refers to a discrete continuous part of the amino acid sequence of a polypeptide that can be equated with a particular function. ZF motifs are largely structurally independent and may retain their structure and function in different environments. Because the ZF motifs are structurally and functionally independent, the motifs also qualify as domains, thus are often referred as ZF domains. Therefore, ZF domains are protein motifs that contain multiple finger-like protrusions that make tandem contacts with their target molecule. Typically, a ZF domain binds a triplet or (overlapping) quadruplet nucleotide sequence. Adjacent ZF domains arranged in tandem are joined together by linker sequences to form an array. A ZF peptide typically contains a ZF array and is composed of a plurality of "ZF domains", which in combination do not exist in nature. Therefore, they are considered to be artificial or synthetic ZF peptides or proteins.

$C_2H_2$ zinc fingers ($C_2H_2$—ZFs) are the most prevalent type of vertebrate DNA-binding domain, and typically appear in tandem arrays (ZFAs), with sequential $C_2H_2$—ZFs each contacting three (or more) sequential bases. $C_2H_2$—ZFs can be assembled in a modular fashion. Given a set of modules with defined three-base specificities, modular assembly also presents a way to construct artificial proteins with specific DNA-binding preferences.

ZF-containing proteins generally contain strings or chains of ZF motifs, forming an array of ZF (ZFA). Thus, a natural ZF protein may include 2 or more ZF, i.e., a ZFA consisting of 2 or more ZF motifs, which may be directly adjacent one another (i.e. separated by a short (canonical) linker sequence), or may be separated by longer, flexible or structured polypeptide sequences. Directly adjacent ZF domains are expected to bind to contiguous nucleic acid sequences, i.e. to adjacent trinucleotides/triplets. In some cases cross-binding may also occur between adjacent ZF and their respective target triplets, which helps to strengthen or enhance the recognition of the target sequence, and leads to the binding of overlapping quadruplet sequences (Isalan et al., (1997) Proc. Natl. Acad. Sci. USA, 94: 5617-5621). By comparison, distant ZF domains within the same protein may recognize (or bind to) non-contiguous nucleic acid sequences or even to different molecules (e.g. protein rather than nucleic acid).

Engineered ZF-containing proteins are chimeric proteins composed of a DNA-binding zinc finger protein domain (ZF protein domain) and another domain through which the protein exerts its effect (effector domain). The effector domain may be a transcriptional activator or repressor, a methylation domain or a nuclease. DNA-binding ZF protein domain would contain engineered zinc finger arrays (ZFAs). See e.g., Khalil et al., Cell Volume 150, Issue 3, 3 Aug. 2012, Pages 647-658; U.S. Pat. No. 10,138,493; US Patent Application US20200002710A1; the contents of each of which are incorporated herein by reference in their entireties.

Engineered ZF-containing proteins are non-natural and suitably contain 3 or more, for example, 4, 5, 6, 8, 9, 10, 11, 12, 13, 14, 15, 16, 17, 18 or more (e.g. up to approximately 30 or 32) ZF motifs arranged adjacent one another in tandem, forming arrays of ZF motifs or ZFA. Particularly ZF-containing synTF proteins (ZF-containing synTF fusion protein, or simply synTF) of the disclosure include at least 3 ZF, at least 4 ZF motifs, at least 5 ZF motifs, or at least 6 ZF motifs, at least 7 ZF motifs, at least 8 ZF motifs, at least 9 ZF motifs, at least 10 ZF motifs, at least 11 or at least 12 ZF motifs; and in some cases at least 18 ZF motifs. In other embodiments, the ZF synTF contains up to 6, 7, 8, 10, 11, 12, 16, 17, 18, 22, 23, 24, 28, 29, 30, 34, 35, 36, 40, 41, 42, 46, 47, 48, 54, 55, 56, 58, 59, or 60 ZF motifs. In some embodiments, the ZF array comprises 1 or more ZF motif. The ZF-containing synTF of the disclosure bind to contiguous orthogonal target nucleic acid binding sites. That is, the ZFs or ZFAs comprising in the ZF domain of the fusion protein binds orthogonal target nucleic acid sequences.

In one embodiment, as used herein, an "engineered synthetic transcription factor" or "engineered synTF" or "synTF" refers to an engineered ZF-containing chimeric protein having at least one of the following characteristics and may have more than one: bind target orthogonal specific DNA sequences and have, for example, reduced or minimal functional binding potential in a host eukaryotic genome; are derived from mammalian protein scaffolds, conferring minimal degree of immunogenicity over other prokaryotically-derived domains; and can be packaging in viral delivery systems, such as lentiviral delivery constructs.

In another embodiment, as used herein, the term "engineered synthetic transcription factor" or "engineered synTF," abbreviated as "synTF" or "ZF synTF," refers to an engineered ZF containing synthetic transcription factor that is a polypeptide, in other words, a ZF-containing synthetic transcription factor protein. These synTFs contain ZF arrays (ZFA) therein for binding to specific target nucleic acid sequences. The synTF is a chimeric, fusion protein that comprises a DNA-binding, ZF-containing protein domain and an effector domain through which the synTF exerts its effect on gene expression. These synTFs can modulate gene expression, wherein the modulation is by increasing or decreasing the expression of a gene that is operably linked to a promoter that is also operably linked to the specific target nucleic acid sequence to which the DNA-binding, ZF-containing protein domain of the synTF binds.

As used herein, the term "ZF array," abbreviated as "ZFA" refers to an array, or a string, or a chain of ZF motifs arranged in tandem. A ZFA can have six ZF motifs (a 6-finger ZFA), seven ZF motifs (a 7-finger ZFA), or eight ZF motifs (an 8-finger ZFA).

As used herein, the term "engineered responsive/response promoter," "engineered promoter," or "engineered responsive/response promoter element" refers is a nucleic acid construct containing a promoter sequence that has at least one orthogonal DNA target sequence operably linked upstream of the promoter sequence such that the orthogonal DNA target sequence confer a responsive property to the promoter when the orthogonal DNA target sequence is bound by its respective transcription factor, the responsive property being whether gene transcription initiation from that promoter is enhanced or repressed when the upstream nearby orthogonal DNA target sequences are bound by a ZF-containing synthetic transcription factor. There may be more than one orthogonal DNA target sequence operably linked upstream of the promoter sequence. When there is one orthogonal DNA target sequence, the promoter is referred to a "1×" promoter, where the "1×" refers to the number of orthogonal DNA target sequence present in the promoter construct. For example, a 4× responsive promoter would be identified as having four orthogonal DNA target sequences in the engineered response promoter construct, and the four orthogonal DNA target sequences are upstream of the promoter sequence.

The ZF protein domain is modular in design, with zinc finger arrays (ZFA) as the main components, and each ZFA is made of 6-8 ZF motifs. The ZF protein domain comprises at least one ZFA, and can contain as many as up to ten ZFA. The ZF protein domain can have one and up to ten ZFA.

The design of the synTF or any engineered fusion protein described herein is also modular, meaning the synTF is made up of modules of ZF domains (ZFA) and modules of effector domains/protein interaction domains/ligand binding domains/dimerization domains, the individual modules are covalently conjugated together as described herein, and the individual modules function independently of each other. The number of ZFA can range from one, two, three, four, five, six, seven, eight, nine, and up to ten. When there are two or more ZFA, the ZFAs are covalently conjugated to each other in tandem, e.g., by a L1 peptide linker, in an NH₂— to COOH— terminus arrangement to form an array of ZFA. The ZFAs, as a whole, forms the ZF protein domain, is covalently linked to the N-terminus or the C-terminus of the effector domain or the regulator protein. When there are two or more ZFAs present in the ZF protein domain of a synTF or a ZF containing fusion protein described herein, the ZFAs can be the same, or different.

Figure 2:
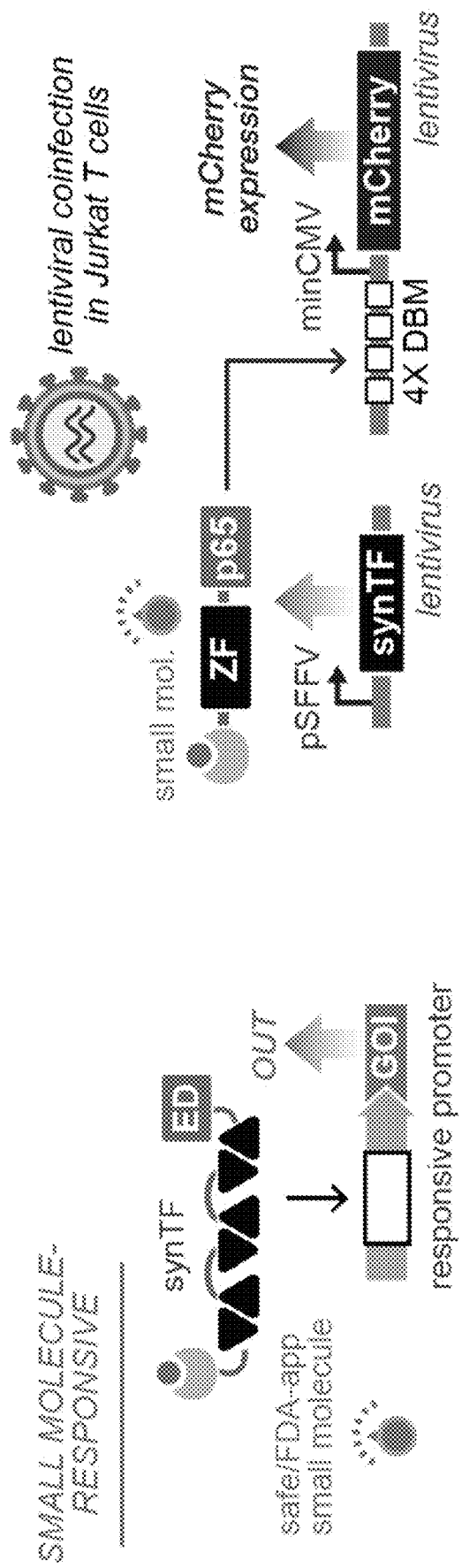
FIG. 2 is a schematic showing a small molecule-responsive synTF system.

Each modular ZFA in the ZF protein domain of a synTF disclosed herein or a ZF containing fusion protein described herein is comprised of six to eight ZF motifs. See FIG. 2B for an example of a single ZFA having seven ZF motifs, a seven-finger ZFA. The ZF motif is a small protein structural motif consisting of an α helix and an antiparallel β sheet (αββ) and is characterized by the coordination of one zinc ion by two histidine residues and two cysteine residues in the motif in order to stabilize the finger-like protrusion fold, the "finger". The ZF motif in the ZF protein domain of a synTF disclosed herein is a Cys₂His₂ zinc finger motif. In one embodiment, the ZF motif comprises, consisting essentially of, or consisting of a peptide of formula 1: $[X_{0-3}CX_{1-5}CX_{2-7}\text{-(helix)-}HX_{3-6}H]$ (SEQ ID NO: 219) wherein X is any amino acid, the subscript numbers indicate the possible number of amino acid residues, C is cysteine, H is histidine, and (helix) is a-six (or seven) contiguous amino acid residue peptide that forms a short alpha helix. The helix is variable. This short alpha helix forms one facet of the finger formed by the coordination of the zinc ion by two histidine residues and two cysteine residues in the ZF motif. For each ZFA, the six to eight ZF motifs therein are linked to each other, NH₂— to COOH— terminus by a peptide linker having about four to six amino acid residues to form an array of ZF motifs or ZF. The finger-like protrusion fold of each ZF motif interacts with and binds nucleic acid sequence. Approximately a peptide sequence for two ZF motif interacts with and binds a ~six-base pair (bp) nucleic acid sequence. The multiple ZF motifs in a ZFA form finger-like protrusions that would make contact with an orthogonal target DNA sequence. Hence, for example, a ZFA with six ZF motifs or finger-like protrusions (a six-finger ZFA) interacts and binds a ~18-20 bp nucleic acid sequence, and an eight-finger ZFA would bind a ~24-26 bp nucleic acid sequence. Accordingly, in one embodiment, the ZFA in the ZF protein domain of a synTF comprises, consists essentially of, or consists of a sequence: N'-[(formula 1)-L₂]₆₋₈-C', where the subscript 6-8 indicates the number of ZF motifs, the L₂ is a linker peptide having 4-6 amino acid residues, and the N'- and C'-indicates the N-terminus and C-terminus respectively of the peptide sequence. For example, for a ZFA consists essentially of six ZF motifs, the sequence is N'-[(formula 1)-L₂]-[(formula 1)-L₂]-[(formula 1)-L₂]-[(formula 1)-L₂]-[(formula 1)-L₂]-[(formula 1)-L₂]-C', and a ZFA consists essentially of eight ZF motifs, the sequence is N'-[(formula 1)-L₂]-[(formula 1)-L₂]-[(formula 1)-L₂]-[(formula 1)-L₂]-[(formula 1)-L₂]-[(formula 1)-L₂]-]-[(formula 1)-L₂]-[(formula 1)-L₂]-C'.

SEQ ID NO: 219:
XXXCXXXXXCXXXXXXXXXXXXXHXXXXXH

In another embodiment of any aspect described herein, the ZF motif comprises a peptide of formula 2: $[X_3CX_2CX_5\text{-(helix)-}HX_3H]$ (SEQ ID NO: 220) wherein X is any amino acid, the subscript numbers indicate the possible number of amino acid residues, C is cysteine, H is histidine, and (helix) is a-six (or seven) contiguous amino acid residue peptide that forms a short alpha helix. Accordingly, in one embodiment, the ZFA in the ZF protein domain of a synTF comprises, consists essentially of, or consists of a sequence: N'-[(formula 2)-L₂]₆₋₈-C', where the subscript 6-8 indicates the number of ZF motifs, the L2 is a linker peptide having 4-6 amino acid residues, and the N'- and C'-indicates the N-terminus and C-terminus respectively of the peptide sequence. For example, for a ZFA consists essentially of six ZF motifs, the sequence is N'-[(formula 2)-L₂]-[(formula 2)-L₂]-[(formula 2)-L₂]-[(formula 2)-L₂]-[(formula 2)-L₂]-[(formula 2)-L₂]-C' and a ZFA consists essentially of eight ZF motifs, the sequence is N'-[(formula 2)-L₂]-[(formula 2)-L₂]-[(formula 2)-L₂]-[(formula 2)-L₂]-[(formula 2)-L₂]-[(formula 2)-L₂]-]-[(formula 2)-L₂]-[(formula 2)-L₂]-C'.

SEQ ID NO: 220:
XXXCXXCXXXXXXXXXXXHXXXH

In one embodiment of any aspect described herein, for a single ZFA is the ZF protein domain of a synTF disclosed herein, the ZFA in the ZF protein domain comprises, consists essentially of, or consists of a sequence: N'-PGER-PFQCRICMRNFS-(Helix 1)-HTRTHT-GEKPFQCRICMRNFS-(Helix 2)-HLRTHTGSQK PFQCRICMRNFS-(Helix 3)-HTRTHTGEK PFQCRICMRNFS-(Helix 4)-HLRTH-TGSQKPFQCRICMRNFS-(Helix 5)-HTRTHTGEK PFQCRICMRNFS-(Helix 6)-HLRTHLR-C' (SEQ ID NO: 380), wherein the (Helix) is a-six (or seven) contiguous amino acid residue peptide that forms a short alpha helix and can also be represented as plain text "xxxxxxx".

SEQ ID NO: 377, Zinc Finger Domain scaffold; *italicized double underlined text* indicates the restriction sites; plain text "xxxxxxx" indicates six ZF helices, e.g., from N terminus to C terminus: helix 1, helix 2, helix 3, helix 4, helix 5, and helix 6 S<u>*RP*</u>GERPFQCRICMRNFSxxxxxxxHTRTH-TGEKPFQCRICMRNFSxxxxxxxHLRTHTGSQKPFQCRI CMRNFSxxxxxxxHTRTHT-GEKPFQCRICMRNFSxxxxxxxHLRTH-TGSQKPFQCRICMRNFSxxxxxxx HTRTHT-GEKPFQCRICMRNFSxxxxxxxHLRTHLR<u>GS</u>

SEQ ID NO: 101, Zinc Finger Domain scaffold, wherein [Helix 1], [Helix 2], [Helix 3], [Helix 4], [Helix 5], and [Helix 6] can also be represented as plain text "xxxxxxx" PGERPFQCRICMRNFS [Helix 1] HTRTHT-GEKPFQCRICMRNFS [Helix 2] HLRTH-TGSQKPFQCRICMRNFS [Helix 3] HLRTHT-GEKPFQCRICMRNFS [Helix 4] HLKTHTGSQKPFQCRICMRNFS [Helix 5] HLRTHT-GEKPFQCRICMRNFS [Helix 6] HLRTHLR SEQ ID NO: 76, Zinc Finger Domain scaffold; *italicized double underlined text* indicates the restriction sites; plain text "xxxxxxx" indicates six ZF helices, e.g., from N terminus to C terminus: helix 1, helix 2, helix 3, helix 4, helix 5, and helix 6 <u>*SRP*</u>GERPFQ-CRICMRNFSxxxxxxxHTRTHT-GEKPFQCRICMRNFSxxxxxxxHLRTHTGSQKPFQCRI CMRNFSxxxxxxxHLRTHT-GEKPFQCRICMRNFSxxxxxxxHLKTH-TGSQKPFQCRICMRNFSxxxxxxx HLRTHT-GEKPFQCRICMRNFSxxxxxxxHLRTHLR<u>GS</u>

In some embodiments of any of the aspects, the zinc finger scaffold comprises one of SEQ ID NOs: 76, 101, 377, 380 or an amino acid sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 76, 101, 377, or 380 that maintains the same function.

In one embodiment, all six of the helix 1, 2, 3, 4, 5 and 6 are distinct and different from each other. In another embodiment, all six of the helix 1, 2, 3, 4, 5 and 6 are identical to each other. Alternatively, at least two of the six helices are identical and the same with each other. In other embodiments, at least three of the six helices in a ZFA are identical and the same with each other, at least four of the six helices in a ZFA are identical and the same with each other, or at least five of the six helices in a ZFA are identical and the same with each other.

In some embodiments of any aspect described herein, the helices of the six to eight ZF motifs of an individual ZFA disclosed herein are selected from the six-amino acid (or seven-amino acid) residue peptide sequences disclosed in one of the following Groups 1-11 (e.g., SEQ ID NOs: 122-180, 192). In some embodiments, at least four of the ZF motifs in an individual ZFA disclosed herein are selected from the six-amino acid (or seven-amino acid) residue peptide sequences disclosed in one of the following Groups 1-11. In other embodiments, all of the ZF motifs, i.e. the six, seven or eight ZF motifs in an individual ZFA disclosed herein, are selected from the six (or seven) amino acid residue peptide sequences disclosed in one of the following Groups 1-11. In any individual ZFA, the helix selected for a single ZF comprising the ZFA can be repeated twice or more in the ZFA. This means that for any given single ZFA, at least four or all the helices in the ZFA are selected from the same group disclosed herein. For example, wherein a ZFA consists essentially of six ZF motifs, that means there are six alpha helices. All the 6-8 helices (Helix 1; Helix 2; Helix 3; Helix 4; Helix 5; Helix 6; Helix 7; Helix 8) of the ZFs in an individual ZFA is selected from one of the following group 1-11, for example, all six helices are selected from group 2. That is, all the helices for all the ZF comprising a single ZFA come from the same group. Alternatively, at least four of the six helices are selected from the same group, a group selected from group 1-11. For example, four of the six helices are selected from group 5, and the reminder two helices of the six-ZF motif ZFA are selected from the other groups 1-4, 6-11, or can be any other helices that would form a short alpha helix. The other remaining helices making up the ZFA can those that are known in the art.

TABLE 10

Groups 1-4 helices

| Group 1 | SEQ ID NO: | Group 2 | SEQ ID NO: | Group 3 | SEQ ID NO: | Group 4 | SEQ ID NO: |
|---|---|---|---|---|---|---|---|
| DEANLRR | 122 | QRSSLVR | 131 | QRSSLVR | 131 | QQTNLTR | 126 |
| DPSVLKR | 123 | DMGNLGR | 132 | DKSVLAR | 140 | QGTSLAR | 146 |
| QSANLLR | 124 | RSHDLTR | 133 | QTNNLGR | 141 | VRHNLTR | 147 |
| DPSSLKR | 125 | HKSSLTR | 134 | THAVLTR | 142 | DKSVLAR | 140 |
| QQTNLTR | 126 | DSSNLRR | 135 | DRGNLTR | 138 | DSSNLRR | 135 |
| DATQLVR | 127 | DQGNLIR | 136 | TKSLLAR | 143 | DQGNLIR | 136 |
| ERRSLAR | 128 | QKQALTR | 137 | QKQALDR | 144 | EKQNLAR | 148 |
| EEANLRR | 129 | DRGNLTR | 138 | DTSVLNR | 145 | DPSNLRR | 149 |
| DHSSLKR | 130 | RSHDLTV | 139 | QRNNLGR | 192 | DHSNLSR | 150 |
|  |  |  |  |  |  | QSTSLQR | 151 |

TABLE 11

Groups 5-7 helices

| Group 5 | SEQ ID NO: | Group 6 | SEQ ID NO: | Group 7 | SEQ ID NO: |
|---|---|---|---|---|---|
| NMSNLTR | 152 | QQTNLTR | 126 | QRSSLVR | 131 |
| DRSVLRR | 153 | QGGNLAL | 160 | QRGNLNM | 164 |
| LQENLTR | 154 | DHSSLKR | 130 | RPQELRR | 165 |
| DRSSLRR | 155 | RADMLRR | 161 | DHSSLKR | 130 |
| QSGTLHR | 156 | DSSNLRR | 135 | RQDNLGR | 166 |
| QLANLAR | 157 | DQGNLIR | 136 | DGGNLGR | 167 |
| DQTTLRR | 158 | EKQNLAR | 148 | QQGNLQL | 168 |
| DPSNLAR | 159 | DPSNLRR | 149 | RRQELTR | 169 |
|  |  | QKANLGV | 162 | DPSNLRR | 149 |
|  |  | RLDMLAR | 163 |  |  |

TABLE 12

Groups 8-11 helices

| Group 8 | SEQ ID NO: | Group 9 | SEQ ID NO: | Group 10 | SEQ ID NO: | Group 11 | SEQ ID NO: |
|---|---|---|---|---|---|---|---|
| QASNLTR | 170 | DSSNLRR | 135 | RRHGLDR | 175 | QLSNLTR | 177 |
| DHSSLKR | 130 | DQGNLIR | 136 | DHSSLKR | 130 | DRSSLKR | 178 |
| RAHNLLL | 171 | RAHNLLL | 171 | VRHNLTR | 147 | QRSSLVR | 131 |
| QRSSLVR | 131 | QRSSLVR | 131 | DHSNLSR | 150 | RLDMLAR | 163 |
| QSTTLKR | 172 | QSTTLKR | 172 | QRSSLVR | 131 | VRHSLTR | 179 |
| DPSNLRR | 149 | DPSNLRR | 149 | ESGHLKR | 176 | ESGALRR | 180 |
| QGTTLKR | 173 | EKQNLAR | 148 |  |  |  |  |
| QRSNLAR | 174 | DSSNLRR | 135 |  |  |  |  |

Non-limiting examples of the combinations and arrangements of six helices in a single ZFA where the helices are selected from Group 1 and where the motifs are in an NH$_2$— to COOH— terminus arrangement, (Group 1 ZFA helix combo), are as follows:
ZF 1-1: N'-DEANLRR, DPSVLKR, QSANLLR, DPSSLKR, QQTNLTR, DATQLVR-C' (SEQ ID NOS 122, 123, 124, 125, 126, and 127, respectively, in order of appearance)
ZF 1-2: N'-DEANLRR, DPSVLKR, QSANLLR, DPSSLKR, QQTNLTR, ERRSLAR-C' (SEQ ID NOS 122, 123, 124, 125, 126, and 128, respectively, in order of appearance)
ZF 1-3: N'-EEANLRR, DHSSLKR, QSANLLR, DPSSLKR QQTNLTR, DATQLVR-C' (SEQ ID NOS 129, 130, 124, 125, 126, and 127, respectively, in order of appearance)
ZF 1-4: N'-EEANLRR, DHSSLKR, QSANLLR, DPSSLKR QQTNLTR, ERRSLAR-C'(SEQ ID NOS 129, 130, 124, 125, 126, and 128, respectively, in order of appearance)
ZF 1-5: N'-DEANLRR, DPSVLKR, QQTNLTR, ERRSLAR QQTNLTR, DATQLVR-C' (SEQ ID NOS 122, 123, 126, 128, 126, and 127, respectively, in order of appearance)

ZF 1-6: N'-DEANLRR, DPSVLKR, QQTNLTR, ERRSLAR QQTNLTR, ERRSLAR-C' (SEQ ID NOS 122, 123, 126, 128, 126, and 128, respectively, in order of appearance)

ZF 1-7: N'-EEANLRR, DHSSLKR, QQTNLTR, ERRSLAR QQTNLTR, DATQLVR-C' (SEQ ID NOS 129, 130, 126, 128, 126, and 127, respectively, in order of appearance)

ZF 1-8: N'-EEANLRR, DHSSLKR, QQTNLTR, ERRSLAR QQTNLTR, ERRSLAR-C' (SEQ ID NOS 129, 130, 126, 128, 126, and 128, respectively, in order of appearance)

Non-limiting examples of the combinations and arrangements of six helices in a single six-finger ZFA where the helices are selected from Group 2 and where the motifs are in an NH$_2$— to COOH— terminus arrangement, (Group 2 ZFA helix combo), are as follows:

ZF 2-1: N'-QRSSLVR, DMGNLGR, RSHDLTR, HKSSLTR, DSSNLRR, DQGNLIR-C' (SEQ ID NOS 131, 132, 133, 134, 135, and 136, respectively, in order of appearance)

ZF 2-2: N'-QKQALTR, DRGNLTR, RSHDLTR, HKSSLTR, DSSNLRR, DQGNLIR-C' (SEQ ID NOS 137, 138, 133, 134, 135, and 136, respectively, in order of appearance)

ZF 2-3: N'-QRSSLVR, DMGNLGR, RSHDLTV, HKSSLTR, DSSNLRR, DQGNLIR-C' (SEQ ID NOS 131, 132, 139, 134, 135, and 136, respectively, in order of appearance)

ZF 2-4: N'-QKQALTR, DRGNLTR, RSHDLTV, HKSSLTR, DSSNLRR, DQGNLIR-C' (SEQ ID NOS 137, 138, 139, 134, 135, and 136, respectively, in order of appearance)

ZF 2-5: N'-QRSSLVR, DMGNLGR, RSHDLTR, HKSSLTR, EKQNLAR, DPSNLRR-C' (SEQ ID NOS 131, 132, 133, 134, 148, and 149, respectively, in order of appearance)

ZF 2-6: N'-QKQALTR, DRGNLTR, RSHDLTR, HKSSLTR, EKQNLAR, DPSNLRR-C' (SEQ ID NOS 137, 138, 133, 134, 148, and 149, respectively, in order of appearance)

ZF 2-7: N'-QRSSLVR, DMGNLGR, RSHDLTV, HKSSLTR, EKQNLAR, DPSNLRR-C' (SEQ ID NOS 131, 132, 139, 134, 148, and 149, respectively, in order of appearance)

ZF 2-8: N'-QKQALTR, DRGNLTR, RSHDLTV, HKSSLTR, EKQNLAR, DPSNLRR-C' (SEQ ID NOS 137, 138, 139, 134, 148, and 149, respectively, in order of appearance)

Non-limiting examples of the combinations and arrangements of six helices in a single six-finger ZFA where the helices are selected from Group 3 and where the motifs are in an NH$_2$— to COOH— terminus arrangement, (Group 3 ZFA helix combo), are as follows:

ZF 3-1: N'-QRSSLVR, DKSVLAR, QRSSLVR, QTNNLGR, THAVLTR, DRGNLTR-C' (SEQ ID NOS 131, 140, 131, 141, 142, and 138, respectively, in order of appearance)

ZF 3-2: N'-QRSSLVR, DKSVLAR, QRSSLVR, QTNNLGR, TKSLLAR, DRGNLTR-C' (SEQ ID NOS 131, 140, 131, 141, 143, and 138, respectively, in order of appearance)

ZF 3-3: N'-QKQALDR, DTSVLNR, QRSSLVR, QTNNLGR, THAVLTR, DRGNLTR-C' (SEQ ID NOS 144, 145, 131, 141, 142, and 138, respectively, in order of appearance)

ZF 3-4: N'-QKQALDR, DTSVLNR, QRSSLVR, QTNNLGR, TKSLLAR, DRGNLTR-C' (SEQ ID NOS 144, 145, 131, 141, 143, and 138, respectively, in order of appearance)

ZF 3-5: N'-QRSSLVR, DKSVLAR, QRSSLVR, QTNNLGR, THAVLTR, DRGNLTR-C' (SEQ ID NOS 131, 140, 131, 141, 142, and 138, respectively, in order of appearance)

ZF 3-6: N'-QRSSLVR, DKSVLAR, QRSSLVR, QTNNLGR, TKSLLAR, DRGNLTR-C' (SEQ ID NOS 131, 140, 131, 141, 143, and 138, respectively, in order of appearance)

ZF 3-7: N'-QKQALDR, DTSVLNR, QRSSLVR, QTNNLGR, THAVLTR, DRGNLTR-C' (SEQ ID NOS 144, 145, 131, 141, 142, and 138, respectively, in order of appearance)

ZF 3-8: N'-QKQALDR, DTSVLNR, QRSSLVR, QTNNLGR, TKSLLAR, DRGNLTR-C' (SEQ ID NOS 144, 145, 131, 141, 143, and 138, respectively, in order of appearance)

In some embodiments of any of the aspects, QRNNLGR (SEQ ID NO: 192) is used in place of QTNNLGR (SEQ ID NO: 141). Non-limiting examples of the combinations and arrangements of six helices in a single six-finger ZFA where the helices are selected from Group 3 and where the motifs are in an NH$_2$— to COOH— terminus arrangement, (Group 3 ZFA helix combo), are as follows:

ZF 3-1: N'-QRSSLVR, DKSVLAR, QRSSLVR, QRNNLGR, THAVLTR, DRGNLTR-C' (SEQ ID NOS 131, 140, 131, 192, 142, and 138, respectively, in order of appearance)

ZF 3-2: N'-QRSSLVR, DKSVLAR, QRSSLVR, QRNNLGR, TKSLLAR, DRGNLTR-C' (SEQ ID NOS 131, 140, 131, 192, 143, and 138, respectively, in order of appearance)

ZF 3-3: N'-QKQALDR, DTSVLNR, QRSSLVR, QRNNLGR, THAVLTR, DRGNLTR-C' (SEQ ID NOS 144, 145, 131, 192, 142, and 138, respectively, in order of appearance)

ZF 3-4: N'-QKQALDR, DTSVLNR, QRSSLVR, QRNNLGR, TKSLLAR, DRGNLTR-C' (SEQ ID NOS 144, 145, 131, 192, 143, and 138, respectively, in order of appearance)

ZF 3-5: N'-QRSSLVR, DKSVLAR, QRSSLVR, QRNNLGR, THAVLTR, DRGNLTR-C' (SEQ ID NOS 131, 140, 131, 192, 142, and 138, respectively, in order of appearance)

ZF 3-6: N'-QRSSLVR, DKSVLAR, QRSSLVR, QRNNLGR, TKSLLAR, DRGNLTR-C' (SEQ ID NOS 131, 140, 131, 192, 143, and 138, respectively, in order of appearance)

ZF 3-7: N'-QKQALDR, DTSVLNR, QRSSLVR, QRNNLGR, THAVLTR, DRGNLTR-C' (SEQ ID NOS 144, 145, 131, 192, 142, and 138, respectively, in order of appearance)

ZF 3-8: N'-QKQALDR, DTSVLNR, QRSSLVR, QRNNLGR, TKSLLAR, DRGNLTR-C' (SEQ ID NOS 144, 145, 131, 192, 143, and 138, respectively, in order of appearance)

Non-limiting examples of the combinations and arrangements of six helices in a single six-finger ZFA where the helices are selected from Group 4 and where the motifs are in an NH$_2$— to COOH— terminus arrangement, (Group 4 ZFA helix combo), are as follows:

ZF 4-1: N'-QQTNLTR, QGTSLAR, VRHNLTR, DKSVLAR, DSSNLRR, DQGNLIR-C' (SEQ ID NOS 126, 146, 147, 140, 135, and 136, respectively, in order of appearance)

ZF 4-2: N'-QQTNLTR, QGTSLAR, VRHNLTR, DKSVLAR, EKQNLAR, DPSNLRR-C' (SEQ ID NOS 126, 146, 147, 140, 148, and 149, respectively, in order of appearance)
ZF 4-3: N'-QQTNLTR, QGTSLAR, VRHNLTR, DHSNLSR, DSSNLRR, DQGNLIR-C' (SEQ ID NOS 126, 146, 147, 150, 135, and 136, respectively, in order of appearance)
ZF 4-4: N'-QQTNLTR, QGTSLAR, VRHNLTR, DHSNLSR, EKQNLAR, DPSNLRR-C' (SEQ ID NOS 126, 146, 147, 150, 148, and 149, respectively, in order of appearance)
ZF 4-5: N'-QQTNLTR, QSTSLQR, VRHNLTR, DKSVLAR, DSSNLRR, DQGNLIR-C' (SEQ ID NOS 126, 151, 147, 140, 135, and 136, respectively, in order of appearance)
ZF 4-6: N'-QQTNLTR, QSTSLQR, VRHNLTR, DKSVLAR, EKQNLAR, DPSNLRR-C' (SEQ ID NOS 126, 151, 147, 140, 148, and 149, respectively, in order of appearance)
ZF 4-7: N'-QQTNLTR, QSTSLQR, VRHNLTR, DHSNLSR, DSSNLRR, DQGNLIR-C' (SEQ ID NOS 126, 151, 147, 150, 135, and 136, respectively, in order of appearance)
ZF 4-8: N'-QQTNLTR, QSTSLQR, VRHNLTR, DHSNLSR, EKQNLAR, DPSNLRR-C' (SEQ ID NOS 126, 151, 147, 150, 148, and 149, respectively, in order of appearance)

Non-limiting examples of the combinations and arrangements of six helices in a single six-finger ZFA where the helices are selected from Group 5 and where the motifs are in an NH$_2$— to COOH— terminus arrangement, (Group 5 ZFA helix combo), are as follows:
ZF 5-1: N'-NMSNLTR, DRSVLRR, LQENLTR, DRSSLRR, QSGTLHR, QSGTLHR-C' (SEQ ID NOS 152, 153, 154, 155, 156, and 156, respectively, in order of appearance)
ZF 5-2: N'-QLANLAR, DQTTLRR, LQENLTR, DRSSLRR, QSGTLHR, QSGTLHR-C' (SEQ ID NOS 157, 158, 154, 155, 156, and 156, respectively, in order of appearance)
ZF 5-3: N'-NMSNLTR, DRSVLRR, DPSNLAR, DRSSLRR, QSGTLHR, QSGTLHR-C' (SEQ ID NOS 152, 153, 159, 155, 156, and 156, respectively, in order of appearance)
ZF 5-4: N'-QLANLAR, DQTTLRR, DPSNLAR, DRSSLRR, QSGTLHR, QSGTLHR-C' (SEQ ID NOS 157, 158, 159, 155, 156, and 156, respectively, in order of appearance)
ZF 5-5: N'-NMSNLTR, DRSVLRR, LQENLTR, DRSSLRR, QSGTLHR, QSGTLHR-C' (SEQ ID NOS 152, 153, 154, 155, 156, and 156, respectively, in order of appearance)
ZF 5-6: N'-QLANLAR, DQTTLRR, LQENLTR, DRSSLRR, QSGTLHR, QSGTLHR-C' (SEQ ID NOS 157, 158, 154, 155, 156, and 156, respectively, in order of appearance)
ZF 5-7: N'-NMSNLTR, DRSVLRR, DPSNLAR, DRSSLRR, QSGTLHR, QSGTLHR-C' (SEQ ID NOS 152, 153, 159, 155, 156, and 156, respectively, in order of appearance)
ZF 5-8: N'-QLANLAR, DQTTLRR, DPSNLAR, DRSSLRR, QSGTLHR, QSGTLHR-C' (SEQ ID NOS 157, 158, 159, 155, 156, and 156, respectively, in order of appearance)

Non-limiting examples of the combinations and arrangements of six helices in a single six-finger ZFA where the helices are selected from Group 6 and where the motifs are in an NH$_2$— to COOH— terminus arrangement, (Group 6 ZFA helix combo), are as follows:
ZF 6-1: N'-QQTNLTR, QGGNLAL, DHSSLKR, RADMLRR, DSSNLRR, DQGNLIR-C' (SEQ ID NOS 126, 160, 130, 161, 135, and 136, respectively, in order of appearance)
ZF 6-2: N'-QQTNLTR, QGGNLAL, DHSSLKR, RADMLRR, EKQNLAR, DPSNLRR-C' (SEQ ID NOS 126, 160, 130, 161, 148, and 149, respectively, in order of appearance)
ZF 6-3: N'-QQTNLTR, QKANLGV, DHSSLKR, RADMLRR, DSSNLRR, DQGNLIR-C' (SEQ ID NOS 126, 162, 130, 161, 135, and 136, respectively, in order of appearance)
ZF 6-4: N'-QQTNLTR, QKANLGV, DHSSLKR, RADMLRR, EKQNLAR, DPSNLRR-C' (SEQ ID NOS 126, 162, 130, 161, 148, and 149, respectively, in order of appearance)
ZF 6-5: N'-QQTNLTR, QGGNLAL, DHSSLKR, RLDMLAR, DSSNLRR, DQGNLIR-C' (SEQ ID NOS 126, 160, 130, 163, 135, and 136, respectively, in order of appearance)
ZF 6-6: N'-QQTNLTR, QGGNLAL, DHSSLKR, RLDMLAR, EKQNLAR, DPSNLRR-C' (SEQ ID NOS 126, 160, 130, 163, 148, and 149, respectively, in order of appearance)
ZF 6-7: N'-QQTNLTR, QKANLGV, DHSSLKR, RLDMLAR, DSSNLRR, DQGNLIR-C' (SEQ ID NOS 126, 162, 130, 163, 135, and 136, respectively, in order of appearance)
ZF 6-8: N'-QQTNLTR, QKANLGV, DHSSLKR, RLDMLAR, EKQNLAR, DPSNLRR-C' (SEQ ID NOS 126, 162, 130, 163, 148, and 149, respectively, in order of appearance)

Non-limiting examples of the combinations and arrangements of six helices in a single six-finger ZFA where the helices are selected from Group 7 and where the motifs are in an NH$_2$— to COOH— terminus arrangement, (Group 7 ZFA helix combo), are as follows:
ZF 7-1: N'-QRSSLVR, QRGNLNM, RPQELRR, DHSSLKR, RQDNLGR, DGGNLGR-C' (SEQ ID NOS 131, 164, 165, 130, 166, and 167, respectively, in order of appearance)
ZF 7-2: N'-QRSSLVR, QQGNLQL, RPQELRR, DHSSLKR, RQDNLGR, DGGNLGR-C' (SEQ ID NOS 131, 168, 165, 130, 166, and 167, respectively, in order of appearance)
ZF 7-3: N'-QRSSLVR, QRGNLNM, RRQELTR, DHSSLKR, RQDNLGR, DGGNLGR-C' (SEQ ID NOS 131, 164, 169, 130, 166, and 167, respectively, in order of appearance)
ZF 7-4: N'-QRSSLVR, QQGNLQL, RRQELTR, DHSSLKR, RQDNLGR, DGGNLGR-C' (SEQ ID NOS 131, 168, 169, 130, 166, and 167, respectively, in order of appearance)
ZF 7-5: N'-QRSSLVR, QRGNLNM, RPQELRR, DHSSLKR, RQDNLGR, DPSNLRR-C' (SEQ ID NOS 131, 164, 165, 130, 166, and 149, respectively, in order of appearance)
ZF 7-6: N'-QRSSLVR, QQGNLQL, RPQELRR, DHSSLKR, RQDNLGR, DPSNLRR-C' (SEQ ID NOS 131, 168, 165, 130, 166, and 149, respectively, in order of appearance)
ZF 7-7: N'-QRSSLVR, QRGNLNM, RRQELTR, DHSSLKR, RQDNLGR, DPSNLRR-C' (SEQ ID NOS 131, 164, 169, 130, 166, and 149, respectively, in order of appearance)
ZF 7-8: N'-QRSSLVR, QQGNLQL, RRQELTR, DHSSLKR, RQDNLGR, DPSNLRR-C' (SEQ ID NOS 131, 168, 169, 130, 166, and 149, respectively, in order of appearance)

Non-limiting examples of the combinations and arrangements of six helices in a single six-finger ZFA where the helices are selected from Group 8 and where the motifs are in an NH₂— to COOH— terminus arrangement, (Group 8 ZFA helix combo), are as follows:

ZF 8-1: N'-QASNLTR, DHSSLKR, RAHNLLL, QRSSLVR, QSTTLKR, DPSNLRR-C' (SEQ ID NOS 170, 130, 171, 131, 172, and 149, respectively, in order of appearance)

ZF 8-2: N'-QASNLTR, DHSSLKR, RAHNLLL, QRSSLVR, QGTTLKR, DPSNLRR-C' (SEQ ID NOS 170, 130, 171, 131, 173, and 149, respectively, in order of appearance)

ZF 8-3: N'-QRSNLAR, DHSSLKR, RAHNLLL, QRSSLVR, QSTTLKR, DPSNLRR-C' (SEQ ID NOS 174, 130, 171, 131, 172, and 149, respectively, in order of appearance)

ZF 8-4: N'-QRSNLAR, DHSSLKR, RAHNLLL, QRSSLVR, QGTTLKR, DPSNLRR-C' (SEQ ID NOS 174, 130, 171, 131, 173, and 149, respectively, in order of appearance)

Non-limiting examples of the combinations and arrangements of six helices in a single six-finger ZFA where the helices are selected from Group 9 and where the motifs are in an NH₂— to COOH— terminus arrangement, (Group 9 ZFA helix combo), are as follows:

ZF 9-1: N'-DSSNLRR, DQGNLIR, RAHNLLL, QRSSLVR, QSTTLKR, DPSNLRR-C' (SEQ ID NOS 135, 136, 171, 131, 172, and 149, respectively, in order of appearance)

ZF 9-2: N'-EKQNLAR, DPSNLRR, RAHNLLL, QRSSLVR, QSTTLKR, DPSNLRR-C' (SEQ ID NOS 148, 149, 171, 131, 172, and 149, respectively, in order of appearance)

ZF 9-3: N'-DSSNLRR, DQGNLIR, RAHNLLL, QRSSLVR, QGTTLKR, DPSNLRR-C' (SEQ ID NOS 135, 136, 171, 131, 173, and 149, respectively, in order of appearance)

ZF 9-4: N'-EKQNLAR, DPSNLRR, RAHNLLL, QRSSLVR, QGTTLKR, DPSNLRR-C' (SEQ ID NOS 148, 149, 171, 131, 173, and 149, respectively, in order of appearance)

A non-limiting example of the combination and arrangement of six helices in a single six-finger ZFA where the helices are selected from Group 10 and where the motif are in an NH₂— to COOH— terminus arrangement, (Group 10 ZFA helix combo), is as follows:

ZF 10-1: N'-RRHGLDR, DHSSLKR, VRHNLTR, DHSNLSR, QRSSLVR, ESGHLKR-C' (SEQ ID NOS 175, 130, 147, 150, 131, and 176, respectively, in order of appearance)

A non-limiting example of the combination and arrangement of six helices in a single six-finger ZFA where the helices are selected from Group 11 and where the motif are in an NH₂— to COOH— terminus arrangement, (Group 11 ZFA helix combo), is as follows:

ZF 11-1: N'-QLSNLTR, DRSSLKR, QRSSLVR, RLDMLAR, VRHSLTR, ESGALRR-C' (SEQ ID NOS 177, 178, 131, 163, 179, and 180, respectively, in order of appearance)

Accordingly, provided herein, in some aspects, are engineered synTF or ZF-containing fusion proteins described herein comprising a ZF protein domain, an effector domain, and a regulator protein, wherein the ZF protein domain comprises at least one ZFA having the ZFA helix combo selected from one of the ZFA helix combo Groups 1-11 disclosed herein. Where there are two or more ZFAs, (i.e., a ZF array) in the ZF protein domain, each ZFAs in the domain has a ZFA helix combo selected from one of the ZFA helix combo Groups 1-11 disclosed herein, and the selected ZFA helix combo groups can be different or duplicated for the each ZFAs in the ZF protein domain of the synTF. For example, when a synTF comprises a ZF protein domain consisting essentially of three ZFAs (ZFA-1-ZFA-2-ZFA-3 in a three-ZFA array) and an effector domain, ZFA-1 has a ZFA helix combo selected from the Group 1 ZFA helix combo, ZFA-2 has a ZFA helix combo selected from the Group 5 ZFA helix combo, and ZFA-3 has a ZFA helix combo selected from the Group 7 ZFA helix combo. In other embodiments, the selected ZFA helix combo groups can be duplicated or triplicated for the ZF array in the synTF. For example, in a three-ZFA array-containing ZF protein domain of a synTF, two of the ZFAs comprises ZFA helix combo selected from the same ZFA helix combo group, e.g., Group 2, and the third ZFA has a ZFA helix combo selected from a different ZFA helix combo group, e.g., Group 4. The two ZFAs having ZFA helix combos selected from the same Group 2 ZFA helix combo can have different or the same actual combination and arrangement of the helices ZFAs. For example, when the synTF comprises of a ZF protein domain consisting essentially of five ZFAs (ZFA-1-ZFA-2-ZFA-3-ZFA-4-ZFA-5 in a five-ZFA array) and an effector domain, ZFA-1 has a ZFA helix combo selected from the Group 1 ZFA helix combo, ZFA-2 has a ZFA helix combo selected from the Group 5 ZFA helix combo, ZFA-3 has a ZFA helix combo also selected from the Group 1 ZFA helix combo, ZFA-4 has a ZFA helix combo selected from the Group 4 ZFA helix combo, and ZFA-5 has a ZFA helix combo selected from the Group 2 ZFA helix combo. While ZFA-1 and ZFA-3 both have ZFA helix combo selected from the Group 1 ZFA helix combo, the actual combination and arrangement of the helices within ZFA-1 and ZFA-3 can be different or the same. For example, ZFA-1 and ZFA-3 have the ZFA helix combo ZF 1-1 and ZF 1-5 respectively, or both ZFA-1 and ZFA-3 have the ZFA helix combo ZF 1-1.

In other aspects, provided herein are engineered synTF or a ZF-containing fusion protein described herein comprising a ZF protein domain and an effector domain, or comprising a ZF protein domain, an effector domain, and a ligand binding domain, or comprising a ZF protein domain and a ligand binding domain or a dimerization domain, wherein the ZF protein domain comprises at least one ZFA having a ZFA helix combo selected from the group consisting of ZF 1-1, ZF 1-2, ZF 1-3, ZF 1-4, ZF 1-5, ZF 1-6, ZF 1-7, ZF 1-8, ZF 2-1, ZF 2-2, ZF 2-3, ZF 2-4, ZF 2-5, ZF 2-6, ZF 2-7, ZF 2- 8, ZF 3-1, ZF 3-2, ZF 3-3, ZF 3-4, ZF 3-5, ZF 3-6, ZF 3-7, ZF 3-8, ZF 4-1, ZF 4-2, ZF 4-3, ZF 4-4, ZF 4- 5, ZF 4-6, ZF 4-7, ZF 4-8, ZF 5-1, ZF 5-2, ZF 5-3, ZF 5-4, ZF 5-5, ZF 5-6, ZF 5-7, ZF 5-8, ZF 6-1, ZF 6- 2, ZF 6-3, ZF 6-4, ZF 6-5, ZF 6-6, ZF 6-7, ZF 6-8, ZF 7-1, ZF 7-2, ZF 7-3, ZF 7-4, ZF 7-5, ZF 7-6, ZF 7- 7, ZF 7-8, ZF 8-1, ZF 8-2, ZF 8-3, ZF 8-4, ZF 9-1, ZF 9-2, ZF 9-3, ZF 9-4, ZF 10-1, and ZF 11-1 disclosed herein.

In some embodiments of any of the aspects, the ZF protein domain comprises at least one ZFA having a ZFA helix combo selected from the group consisting of ZF1-3, ZF2-6, ZF3-5, ZF4-8, ZF5-7, ZF6-4, ZF7-3, ZF8-1, ZF9-2, ZF10-1, and ZF11-1, which are also referred to herein as ZF1, ZF2, ZF3, ZF4, ZF5, ZF6, ZF7, ZF8, ZF9, ZF10, and ZF11, respectively.

In some embodiments of any aspect described herein, in the synTF described or any ZF-containing fusion protein described herein, the individual ZFA therein described are specifically designed to bind orthogonal target DNA sequences (also referred to herein as DNA binding motifs) such as the following:

```
Target 1:
                                       (SEQ ID NO: 181)
5' C GTC GAA GTC GAA GTC GAC C 3'

Target 2:
                                       (SEQ ID NO: 182)
5' G GAC GAC GTT ACG GAC GTA C 3'

Target 3:
                                       (SEQ ID NO: 183)
5' A GAC GTC GAA GTA GCC GTA G 3'

Target 4:
                                       (SEQ ID NO: 184)
5' G GAC GAC GCC GAT GTA GAA G 3'

Target 5:
                                       (SEQ ID NO: 185)
5' T GAA GCA GTC GAC GCC GAA G 3'

Target 6:
                                       (SEQ ID NO: 186)
5' G GAC GAC GCG GTC TAA GAA G 3'

Target 7:
                                       (SEQ ID NO: 187)
5' C GAC GAG GTC GCA TAA GTA G 3'

Target 8:
                                       (SEQ ID NO: 188)
5' A GAC GCA GTA TAG GTC GAA C 3'

Target 9:
                                       (SEQ ID NO: 189)
5' A GAC GCA GTA TAG GAC GAC G 3'

Target 10:
                                       (SEQ ID NO: 190)
5' C GGC GTA GCC GAT GTC GCG C 3'

Target 11:
                                       (SEQ ID NO: 191)
5' G GTC GTT GCG GTA GTC GAA G 3'
```

In some embodiments of any the aspects, the ZF binding domain specifically binds to a sequence comprising at least one of SEQ ID NOs: 181-191 or to a nucleic acid sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 181-191 that maintains the same function.

In some embodiments of any of the aspects, ZF 1-1, ZF 1-2, ZF 1-3, ZF 1-4, ZF 1-5, ZF 1-6, ZF 1-7, and ZF 1-8 bind to Target 1. In some embodiments of any of the aspects, ZF 2-1, ZF 2-2, ZF 2-3, ZF 2-4, ZF 2-5, ZF 2-6, ZF 2-7, and ZF 2-8 bind to Target 2. In some embodiments of any of the aspects, ZF 3-1, ZF 3-2, ZF 3-3, ZF 3-4, ZF 3-5, ZF 3-6, ZF 3-7, and ZF 3-8 bind to Target 3. In some embodiments of any of the aspects, ZF 4-1, ZF 4-2, ZF 4-3, ZF 4-4, ZF 4-5, ZF 4-6, ZF 4-7, ZF 4-8 bind to Target 4. In some embodiments of any of the aspects, ZF 5-1, ZF 5-2, ZF 5-3, ZF 5-4, ZF 5-5, ZF 5-6, ZF 5-7, and ZF 5-8 bind to Target 5. In some embodiments of any of the aspects, ZF 6-1, ZF 6-2, ZF 6-3, ZF 6-4, ZF 6-5, ZF 6-6, ZF 6-7, and ZF 6-8 bind to Target 6. In some embodiments of any of the aspects, ZF 7-1, ZF 7-2, ZF 7-3, ZF 7-4, ZF 7-5, ZF 7-6, ZF 7-7, and ZF 7-8 bind to Target 7. In some embodiments of any of the aspects, ZF 8-1, ZF 8-2, ZF 8-3, and ZF 8-4 bind to Target 8. In some embodiments of any of the aspects, ZF 9-1, ZF 9-2, ZF 9-3, and ZF 9-4 bind to Target 9. In some embodiments of any of the aspects, ZF10-1 binds to Target 10. In some embodiments of any of the aspects, ZF11-1 binds to Target 11.

In one embodiment of any aspect described herein, provided herein is a ZFA that comprises, consists of, or consist essentially of a sequence: N'-[(formula 1)-$L_2]_{6-8}$-C' or a sequence N'-[(formula 2)-$L_2]_{6-8}$-C' that targets a target DNA sequence selected from Target 1-11, wherein the formula 1 is $[X_{0-3}CX_{1-5}CX_{2-7}$-(helix)-$HX_{3-6}H]$ (SEQ ID NO: 219) and the formula 2 is $[X_3CX_2CX_5$-(helix)-$HX_3H]$ (SEQ ID NO: 220).

In other aspects, provided herein are engineered synTF or the ZF containing fusion protein described herein comprising a ZF protein domain and an effector domain, or comprising a ZF protein domain, an effector domain, and a ligand binding domain, or comprising a ZF protein domain and a ligand binding domain or a dimerization domain, wherein the ZF protein domain comprises at least one ZFA, wherein the an least ZFA comprises, consists of, or consist essentially of a sequence: N'-[(formula 1)-$L_2]_{6-8}$-C' or a sequence N'-[(formula 2)-$L_2]_{6-8}$-C', and wherein the ZFA(s) therein targets a target DNA sequence selected from Target 1-11, wherein the formula 1 is $[X_{0-3}CX_{1-5}CX_{2-7}$-(helix)-$HX_{3-6}H]$ (SEQ ID NO: 219) and the formula 2 is $[X_3CX_2CX_5$-(helix)-$HX_3H]$ (SEQ ID NO: 220).

In some embodiments of any of the aspects, the ZF binding domain comprises one of SEQ ID NOs: 1-3, or an amino acid sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 1-3 that maintains the same function.

```
Sequence of ZF1-3 (ZF1)
                                         SEQ ID NO: 1
SRPGERPFQCRICMRNFSEEANLRRHTRTHTGEKPFQCRICMRNFSDHSS

LKRHLRTHTGSQKPFQCRICMRNFSQSANLLRHTRTHTGEKPFQCRICMR

NFSDPSSLKRHLRTHTGSQKPFQCRICMRNFSQQTNLTRHTRTHTGEKPF

QCRICMRNFSDATQLVRHLRTHLRGS,

Sequence of ZF3-5 (ZF3)
                                         SEQ ID NO: 2
SRPGERPFQCRICMRNFSQRSSLVRHTRTHTGEKPFQCRICMRNFSDKSV

LARHLRTHTGSQKPFQCRICMRNFSQRSSLVRHTRTHTGEKPFQCRICMR

NFSQRNNLGRHLRTHTGSQKPFQCRICMRNFSTHAVLTRHTRTHTGEKPF

QCRICMRNFSDRGNLTRHLRTHLRGS,

Sequence of ZF10-1 (ZF10)
                                         SEQ ID NO: 3
SRPGERPFQCRICMRNFSRRHGLDRHTRTHTGEKPFQCRICMRNFSDHSS

LKRHLRTHTGSQKPFQCRICMRNFSVRHNLTRHLRTHTGEKPFQCRICMR

NFSDHSNLSRHLKTHTGSQKPFQCRICMRNFSQRSSLVRHLRTHTGEKPF

QCRICMRNFSESGHLKRHLRTHLRGS,
```

In some embodiments of any of the aspects, the DBD comprises a 3-unit ZF protein. In some embodiments of any of the aspects, the 3-unit ZF protein comprises one of SEQ ID NOs: 221-228 or an amino acid sequence that is at least 60%, at least 65%, at least 70%, at least 75%, at least 80%, at least 85%, at least 90%, at least 95%, at least 96%, at least 97%, at least 98%, or at least 99% identical to one of SEQ ID NOs: 221-228 that maintains the same function.

SEQ ID NO: 221 high affinity scaffold (bolded letter shows mutated residue, and plain text "xxxxxxx" indicates three ZF helices, e.g., from N terminus to C terminus: helix 1, helix 2, helix 3, respectively) GERPFQCRIC- MANFSxxxxxxxHTRTHTGEKPFQCRIC-
MANFSxxxxxxxHLRTHTGEKPFQCRICMA
NFSxxxxxxxHLKTHLR SEQ ID NO: 222 low affinity scaffold (bolded letter shows mutated residue, and bold italic text indicates helices 1, 2, and 3 respectively) GEAPFQCRIC-MANFSxxxxxxxHTRTHTGEKPFQCRIC-MANFSxxxxxxxHLRTHTGEKPFQCRICMA
NFSxxxxxxxHLKTHLR In some embodiments of any of the aspects, the at least one DBD is selected from the group consisting of: 13-6, 14-3, 21-16, 36-4, 37-12, 42-10, 43-8, 54-8, 55-1, 62-1, 92-1, 93-10, 97-4, 129-3, 150-4, 151-1, 158-2, 172-5, and 173-3; see e.g., Khalil et al., Cell Volume 150, Issue 3, 3 Aug. 2012, Pages 647-658; U.S. Pat. No. 10,138,493; US Patent Application US20200002710A1; the contents of each of which are incorporated herein by reference in their entireties. In some embodiments of any of the aspects, the at least one DBD is selected from one or more of any of: 36-4 (SEQ ID NO: 223), 43-8 (SEQ ID NO: 224 or 225), 42-10 (SEQ ID NO: 226-227), 97-4 (SEQ ID NO: 228).

```
36-4 (bold italic text indicates helices 1, 2, and 3 respectively)
                                                      SEQ ID NO: 223
GERPFQCRICMANFSGRQALDRHTRTHTGEKPFQCRICMANFSDKANLTRHLRTHTGEKPFQCRI

CMANFSQRNNLGRHLKTHLR, 43-8 low affinity (bolded letter shows mutated resi-
due, and bold italic text
indicates helices 1, 2, and 3 respectively)
                                                      SEQ ID NO: 224
GEAPFQCRICMANFSRQDRLDRHTRTHTGEKPFQCRICMANFSQKEHLAGHLRTHTGEKPFQCRI

CMANFSRRDNLNRHLKTHLR 43-8 high affinity (bolded letter shows mutated resi-
due, and bold italic text
indicates helices 1, 2, and 3 respectively)
                                                      SEQ ID NO: 225
GERPFQCRICMANFSRQDRLDRHTRTHTGEKPFQCRICMANFSQKEHLAGHLRTHTGEKPFQCRI

CMANFSRRDNLNRHLKTHLR 42-10 low affinity (bolded letter shows mutated residue, and bold italic
text indicates helices 1, 2, and 3 respectively)
                                                      SEQ ID NO: 226
GEAPFQCRICMANFSTGQILDRHTRTHTGEKPFQCRICMANFSVAHSLKRHLRTHTGEKPFQCRTC

MANFSDPSNLRRHLKTHLR 42-10 high affinity (bolded letter shows mutated residue, and bold italic
text indicates helices 1, 2, and 3 respectively)
                                                      SEQ ID NO: 227
GERPFQCRICMANFSTGQILDRHTRTHTGEKPFQCRICMANFSVAHSLKRHLRTHTGEKPFQCRTC

MANFSDPSNLRRHLKTHLR 97-4 (bold italic text indicates helices 1, 2, and 3 respectively)
                                                      SEQ ID NO: 228
GERPFQCRICMRNFSRQSNLSRHTRTHTGEKPFQCRICMRNFSRNEHLVLHLRTHTGEKPFQCRIC
MRNFSQKTGLRVHLKTHLR,
```

In some embodiments of any of the aspects, the DBD binds to DNA binding motifs (DBM) comprising any of: SEQ ID NOs: 229-240.

SEQ ID NO: 229 is an exemplary DBM (DNA binding motif) nucleic acid sequence for 36-4: c GAA GAC GCT g.

SEQ ID NO: 230-SEQ ID NO: 232 are exemplary DBM affinity variant nucleic acid sequences for 43-8. Bold text indicates residues mutated from the WT sequence. SEQ ID NO: 230 is 43-8 DBM1-aGAGTGAGGAc. SEQ ID NO: 231 is 43-8 DBM2-aCAGTGAGGAc. SEQ ID NO: 232 is 43-8 DBM3-aTAGTGAGGAc.

SEQ ID NOS 233-239 are exemplary DBM affinity variant nucleic acid sequences for 42-10. Bold text indicates residues mutated from the WT sequence. SEQ ID NO: 233 is 42-10 DBM1-aGACGCTGCTc. SEQ ID NO: 234 is 42-10 DBM2-tGACGCTGCTt. SEQ ID NO: 235 is 42-10 DBM3-aGACGGTGCTc. SEQ ID NO: 236 is 42-10 DBM4-aCACGCTGCTc. SEQ ID NO: 237 is 42-10 DBM5-aGACGCTACTc. SEQ ID NO: 238 is 42-10 DBM6-aGACGCTGCTa. SEQ ID NO: 239 is 42-10 DBM7-aGACTCTGCTc.

SEQ ID NO: 240 is an exemplary DBM (DNA binding motif) nucleic acid sequence for 97-4: a TTA TGG GAG a.

Repressible Protease Domain

In some embodiments of any of the aspects, a synTF as described herein comprises a regulator protein, wherein the regulator protein is a repressible protease domain (referred to herein as PRO or RPD). As used herein, the term "repressible protease" refers to a protease that can be inactivated by the presence or absence of a specific agent (e.g., that specifically binds to the protease). In some embodiments, a repressible protease is active (e.g., cleaves a protease cleavage site) in the absence of the specific agent and is inactive (e.g., does not cleave a protease cleavage site) in the presence of the specific agent. In some embodiments, the specific agent is a protease inhibitor. In some embodiments, the protease inhibitor specifically inhibits a given repressible protease as described herein.

In some embodiments of any of the aspects, a synTF polypeptide as described herein (or a synTF polypeptide system collectively) comprises 1, 2, 3, 4, 5, or more repressible protease(s). In some embodiments of any of the aspects, the synTF polypeptide or system comprises one repressible protease. In embodiments comprising multiple repressible proteases, the multiple repressible proteases can be different individual repressible proteases or multiple copies of the same repressible protease, or a combination of the foregoing.

Non-limiting examples of repressible proteases include hepatitis C virus proteases (e.g., NS3 and NS2-3); HIV1 protease; coronavirus (main) protease; Tobacco etch virus (TEV) protease; signal peptidase; proprotein convertases of the subtilisin/kexin family (furin, PCI, PC2, PC4, PACE4, PC5, PC); proprotein convertases cleaving at hydrophobic residues (e.g., Leu, Phe, Val, or Met); proprotein convertases cleaving at small amino acid residues such as Ala or Thr; proopiomelanocortin converting enzyme (PCE); chromaffin granule aspartic protease (CGAP); prohormone thiol protease; carboxypeptidases (e.g., carboxypeptidase E/H, carboxypeptidase D and carboxypeptidase Z); aminopeptidases (e.g., arginine aminopeptidase, lysine aminopeptidase, aminopeptidase B); prolyl endopeptidase; aminopeptidase N; insulin degrading enzyme; calpain; high molecular weight protease; and, caspases 1, 2, 3, 4, 5, 6, 7, 8, and 9. Other proteases include, but are not limited to, aminopeptidase N; puromycin sensitive aminopeptidase; angiotensin converting enzyme; pyroglutamyl peptidase II; dipeptidyl peptidase IV; N-arginine dibasic convertase; endopeptidase 24.15; endopeptidase 24.16; amyloid precursor protein secretases alpha, beta and gamma; angiotensin converting enzyme secretase; TGF alpha secretase; T F alpha secretase; FAS ligand secretase; TNF receptor-I and -II secretases; CD30 secretase; KL1 and KL2 secretases; IL6 receptor secretase; CD43, CD44 secretase; CD 16-1 and CD 16-11 secretases; L-selectin secretase; Folate receptor secretase; MMP 1, 2, 3, 7, 8, 9, 10, 11, 12, 13, 14, and 15; urokinase plasminogen activator; tissue plasminogen activator; plasmin; thrombin; BMP-1 (procollagen C-peptidase); ADAM 1, 2, 3, 4, 5, 6, 7, 8, 9, 10, and 11; and, granzymes A, B, C, D, E, F, G, and H. For a discussion of proteases, see, e.g., V. Y. H. Hook, Proteolytic and cellular mechanisms in prohormone and proprotein processing, RG Landes Company, Austin, Tex., USA (1998); N. M. Hooper et al., Biochem. J. 321: 265-279 (1997); Z. Werb, Cell 9 1: 439-442 (1997); T. G. Wolfsberg et al., J. Cell Biol. 131: 275-278 (1995); K. Murakami and J. D. Etlinger, Biochem. Biophys. Res. Comm. 146: 1249-1259 (1987); T. Berg et al., Biochem. J. 307: 313-326 (1995); M. J. Smyth and J. A. Trapani, Immunology Today 16: 202-206 (1995); R. V. Talanian et al., J. Biol. Chem. 272: 9677-9682 (1997); and N. A. Thomberry et a, J. Biol. Chem. 272: 17907-1791 1 (1997); International Patent Application WO2019118518; Rajakuberan et al., Methods Mol Biol. 2012; 903:393-405; Gao et al. Science 21 Sep. 2018: Vol. 361, Issue 6408, pp. 1252-1258; Tague et al., Nat Methods. 2018 July; 15(7):519-522; Lin et al. PNAS Jun. 3, 2008 105 (22) 7744-7749; U.S. patent application Ser. No. 16/832,751 filed Mar. 27, 2020; the contents of each of which are incorporated herein by reference in their entireties.

In some embodiments of any of the aspects, the repressible protease is hepatitis C virus (HCV) nonstructural protein 3 (NS3). NS3, also known as p-70, is a viral nonstructural protein that is a 70 kDa cleavage product of the hepatitis C virus polyprotein. The 631-residue HCV NS3 protein is a dual-function protein, containing the trypsin/chymotrypsin-like serine protease in the N-terminal region and a helicase and nucleoside triphosphatase in the C-terminal region. The minimal sequences required for a functional serine protease activity comprise the N-terminal 180 amino acids of the NS3 protein, which can also be referred to as "NS3a". Deletion of up to 14 residues from the N terminus of the NS3 protein is tolerated while maintaining the serine protease activity. Accordingly, the repressible proteases described herein comprise at the least residues 14-180 of the wildtype NS3 protein.

HCV has at least seven genotypes, labeled 1 through 7, which can also be further designated with "a" and "b" subtypes. Accordingly, the repressible protease can be an HCV genotype 1 NS3, an HCV genotype 1a NS3, an HCV genotype 1b NS3, an HCV genotype 2 NS3, an HCV genotype 2a NS3, an HCV genotype 2b NS3, an HCV genotype 3 NS3, an HCV genotype 3a NS3, an HCV genotype 3b NS3, an HCV genotype 4 NS3, an HCV genotype 4a NS3, an HCV genotype 4b NS3, an HCV genotype 5 NS3, an HCV genotype 5a NS3, an HCV genotype 5b NS3, an HCV genotype 6 NS3, an HCV genotype 6a NS3, an HCV genotype 6b NS3, an HCV genotype 7 NS3, an HCV genotype 7a NS3, or an HCV genotype 7b NS3. In some embodiments of any of the aspects, the repressible protease can be any known HCV NS3 genotype, variant, or mutant, e.g., that maintains the same function. In some embodiments of any of the aspects, the NS3 sequence comprises residues 1-180 of the NS3 protein from HCV-H, HCV-1, HCV-J1, HCV-BK, HCV-JK1, HCV-J4, HCV-J, HCV-J6, C14112, HCV-J8, D14114, HCV-Nz11, or HCV-K3a (see e.g., Chao Lin, Chapter 6: HCV NS3-4A Serine Protease, Hepatitis C Viruses: Genomes and Molecular Biology, Editor: Tan S L, Norfolk (UK): Horizon Bioscience, 2006; the content of which is incorporated herein by reference in its entirety). In some embodiments of any of the aspects, the repressible protease is a chimera of 2, 3, 4, 5, or more different NS3 genotypes, variants, or mutants as described herein, such that the protease maintains its cleavage and/or binding functions.

In some embodiments of any of the aspects, the repressible protease of a synTF polypeptide as described herein comprises SEQ ID NOs: 82, 91, 241-255 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 82, 91, 241-255 that maintains the same function.

In some embodiments of any of the aspects, the repressible protease of a synTF polypeptide as described herein does not comprise at most the first (i.e., N-terminal) residues of SEQ ID NOs: 82, 91, 241-255. In some embodiments of any of the aspects, the repressible protease of a synTF polypeptide as described herein comprises residues 1-180, 2-180, 3-180, 4-180, 5-180, 6-180, 7-180, 8-180, 9-180, 10-180, 11-180, 12-180, 13-180, 14-180, 15-180, 16-180, 17-180, 18-180, 19-180, 20-180, 21-180, 22-180, 23-180, 24-180, 25-180, 26-180, 27-180, 28-180, 29-180, or 30-180 of SEQ ID NOs: 82, 91, 241-255.

NS3 (genotype 1A), 189 aa; bold text indicates
His-57 of the catalytic triad; *italicized double underlined text*
indicates Asp-81 of the catalytic triad; _bold italicized_
indicates Ser-139 of the catalytic triad;
double underlined text indicates Asp-168.

SEQ ID NO: 82

APITAYAQQTRGLLGCIITSLTGRDKNQVEGEVQIVSTATQTFLATCINGVCWAVYHGAGTRTIA

SPKGPVIQMYTNVDQ*D*LVGWPAPQGSRSLTPCTCGSSDLYLVTRHADVIPVRRRGDSRGSLLSPR

PISYLKGS_S_GGPLLCPAGHAVGLFRAAVCTRGVAKAV<u>D</u>FIPVENLETTMRSPVFTDNSS,

NS3 protease domain (genotype 1A)

SEQ ID NO: 91

APITAYAQQTRGLLGCIITSLTGRDKNQVEGEVQIVSTATQTFLATCINGVCWAVYHGAGTRTIA

SPKGPVIQMYTNVDQDLVGWPAPQGSRSLTPCTCGSSDLYLVTRHADVIPVRRRGDSRGSLLSPR

PISYLKGSSGGPLLCPAGHAVGLFRAAVCTRGVAKAVDFIPVENLETTMRSPVFTD,

NS3 (genotype 1A), 180 aa (see e.g., residues
1027-1206 of Hepatitis C virus genotype 1 polyprotein,
NCBI Reference Sequence: NP_671491.1.

SEQ ID NO: 241

APITAYAQQTRGLLGCIITSLTGRDKNQVEGEVQIVSTATQTFLATCINGVCWTVYHGAGTRTIA

SPKGPVIQMYTNVDQDLVGWPAPQGSRSLTPCTCGSSDLYLVTRHADVIPVRRRGDSRGSLLSPR

PISYLKGSSGGPLLCPAGHAVGLFRAAVCTRGVAKAVDFIPVENLETTMR,

NS3 (genotype 1B), 180 aa (see e.g., residues
1-180 Chain A. Ns3 Protease, PDB: 4K8B_A)

SEQ ID NO: 242

APITAYSQQTRGLLGCIITSLTGRDKNQVEGEVQVVSTATQSFLATCVNGVCWTVYHGAGSKTLA

GPKGPITQMYTNVDQDLVGWQAPPGARSLTPCTCGSSDLYLVTRHADVIPVRRRGDSRGSLLSP

RPVSYLKGSSGGPLLCPSGHAVGIFRAAVCTRGVAKAVDFVPVESMETTMR,

NS3 (genotype 2), 180 aa (see e.g., residues
1031-1210 of Hepatitis C virus genotype 2 polyprotein,
NCBI Reference Sequence: YP_001469630.1

SEQ ID NO: 243

APITAYAQQTRGLLGTIVVSMTGRDKTEQAGEIQVLSTVTQSFLGTSISGVLWTVYHGAGNKTLA

GSRGPVTQMYSSAEGDLVGWPSPPGTKSLEPCTCGAVDLYLVTRNADVIPARRRGDKRGALLSPR

PLSTLKGSSGGPVLCPRGHAVGVFRAAVCSRGVAKSIDFIPVETLDIVTR,

NS3 (genotype 3), 180 aa (see e.g., residues
1033-1212 of Hepatitis C virus genotype 3 polyprotein,
NCBI Reference Sequence: YP_001469631.1)

SEQ ID NO: 244

APITAYAQQTRGLLGTIVTSLTGRDKNVVTGEVQVLSTATQTFLGTTVGGVIWTVYHGAGSRTL

AGAKHPALQMYTNVDQDLVGWPAPPGAKSLEPCACGSSDLYLVTRDADVIPARRRGDSTASLLS

PRPLACLKGSSGGPVMCPSGHVAGIFRAAVCTRGVAKSLQFIPVETLSTQAR,

NS3 (genotype 4), 180 aa (see e.g., residues
1027-1206 of Hepatitis C virus genotype 4 polyprotein,
NCBI Reference Sequence: YP_001469632.1)

SEQ ID NO: 245

APITAYAQQTRGLFSTIVTSLTGRDTNENCGEVQVLSTATQSFLGTAVNGVMWTVYHGAGAKTI

SGPKGPVNQMYTNVDQDLVGWPAPPGVRSLAPCTCGSADLYLVTRHADVIPVRRRGDTRGALLS

PRPISILKGS SGGPLLCPMGHRAGIFRAAVCTRGVAKAVDFVPVESLETTMR,

NS3 (genotype 5), 180 aa (see e.g., residues
1028-1207 of Hepatitis C virus genotype 5 polyprotein,
NCBI Reference Sequence: YP_001469633.1)

SEQ ID NO: 246

APITAYAQQTRGVLGAIVLSLTGRDKNEAEGEVQFLSTATQTFLGICINGVMWTLFHGAGSKTLA

GPKGPVVQMYTNVDKDLVGWPSPPGKGSLTRCTCGSADLYLVTRHADVIPARRRGDTRASLLSPR

PISYLKGSSGGPIMCPSGHVVGVFRAAVCTRGVAKALEFVPVENLETTMR,

-continued

NS3 (genotype 6), 180 aa (see e.g., residues
1032-1211 of Hepatitis C virus genotype 6 polyprotein,
NCBI Reference Sequence: YP_001469634.1)
SEQ ID NO: 247
APITAYAQQTRGLVGTIVTSLTGRDKNEAEGEVQVVSTATQSFLATTINGVLWTVYHGAGSKNL

AGPKGPVCQMYTNVDQDLVGWPAPLGARSLAPCTCGSSDLYLVTRGADVIPARRRGDTRAALLS

PRPISTLKGSSGGPLMCPSGHVVGLFRAAVCTRGVAKALDFIPVENMDTTMR,

NS3 (genotype 7), 180 aa (see e.g., residues
1031-1210 of Hepatitis C virus genotype 7 polyprotein,
NCBI Reference Sequence: YP_009272536.1)
SEQ ID NO: 248
APISAYAQQTRGLISTLVVSLTGRDKNETAGEVQVLSTSTQTFLGTNVGGVMWGPYHGAGTRTV

AGRGGPVLQMYTSVSDDLVGWPAPPGSKSLEPCSCGSADLYLVTRNADVLPLRRKGDGTASLLS

PRPVSSLKGSSGGPVLCPQSHCVGIFRAAVCTRGVAKAVQFVPIEKMQVAQR,

NS3 genotype 1a (HCV-H), 180 aa
SEQ ID NO: 249
APITAYAQQTRGLLGCIITSLTGRDKNQVEGEVQIVSTATQTFLATCINGVCWTVYHGAGTRTI

ASPKGPVIQMYTNVDQDLVGWPAPQGSRSLTPCTCGSSDLYLVTRHADVIPVRRRGDSRGSLLS

PRPISYLKGSSGGPLLCPAGHAVGLFRAAVCTRGVTKAVDFIPVENLETTMR,

NS3 genotype 1b (HCV-BK), 180 aa
SEQ ID NO: 250
APITAYSQQTRGLLGCIITSLTGRDKNQVEGEVQVVSTATQSFLATCVNGVCWTVYHGAGSKTL

AAPKGPITQMYTNVDQDLVGWPKPPGARSLTPCTCGSSDLYLVTRHADVIPVRRRGDSRGSLLS

PRPVSYLKGSSGGPLLCPFGHAVGIFRAAVCTRGVAKAVDFVPVESMETTMR,

NS3 genotype 2a (HCV-J6), 180 aa
SEQ ID NO: 251
APITAYAQQTRGLLGTIVVSMTGRDKTEQAGEIQVLSTVTQSFLGTTISGVLWTVYHGAGNKTL

AGSRGPVTQMYSSAEGDLVGWPSPPGTKSLEPCTCGAVDLYLVTRNADVIPARRRGDKRGALLS

PRPLSTLKGSSGGPVLCPRGHAVGVFRAAVCSRGVAKSIDFIPVETLDIVTR,

NS3 genotype 2b (HCV-J8), 180 aa
SEQ ID NO: 252
APITAYTQQTRGLLGAIVVSLTGRDKNEQAGQVQVLSSVTQTFLGTSISGVLWTVYHGAGNKTL

AGPKGPVTQMYTSAEGDLVGWPSPPGTKSLDPCTCGAVDLYLVTRNADVIPVRRKDDRRGALLS

PRPLSTLKGSSGGPVLCSRGHAVGLFRAAVsynTFGVAKSIDFIPVESLDVATR,

NS3 genotype 3a (HCV-Nz11), 180 aa
SEQ ID NO: 253
APITAYAQQTRGLLGTIVTSLTGRDKNVVTGEVQVLSTATQTFLGTTVGGVIWTVYHGAGSRTL

AGAKHPALQMYTNVDQDLVGWPAPPGAKSLEPCACGSSDLYLVTRDADVIPARRRGDSTASLLS

PRPLACLKGSSGGPVMCPSGHVAGIFRAAVCTRGVAKSLQFIPVETLSTQAR,

In some embodiments of any of the aspects, a repressible protease as described herein is resistant to 1, 2, 3, 4, 5, or more different protease inhibitors as described herein. Non-limiting examples of NS3 amino acid substitutions conferring resistance to HCV NS3 protease inhibitors include: V36L (e.g., genotype 1b), V36M (e.g., genotype 2a), T54S (e.g., genotype 1b), Y56F (e.g., genotype 1b), Q80L (e.g., genotype 1b), Q80R (e.g., genotype 1b), Q80K (e.g., genotype 1a, 1b, 6a), Y132I (e.g., genotype 1b), A156S (e.g., genotype 2a), A156G, A156T, A156V, D168A (e.g., genotype 1b), I170V (e.g., genotype 1b), S20N, R26K, Q28R, A39T, Q41R, I71V, Q80R, Q86R, P89L, P89S, S101N, A111S, P115S, S122R, R155Q, L144F, A150V, R155W, V158L, D168A, D168G, D168H, D168N, D168V, D168E, D168Y, E176K, T178S, M179I, M179V, and M179T. See e.g., Sun et al., Gene Expr. 2018, 18(1): 63-69; Kliemann et al., World J Gastroenterol. 2016 Oct. 28, 22(40): 8910-8917; U.S. Pat. Nos. 7,208,309; 7,494,660; the contents of each of which are incorporated herein by reference in their entireties.

In some embodiments of any of the aspects, a synTF polypeptide as described herein comprises an NS3 protease comprising at least one resistance mutation as described herein or any combination thereof. In some embodiments of any of the aspects, a synTF polypeptide as described herein comprises an NS3 protease that is resistant to one protease inhibitor but responsive to at least one other protease inhibitor. In some embodiments of any of the aspects, a synTF system comprises: (a) a first synTF polypeptide comprising a repressible protease (e.g., NS3) that is resistant to a first protease inhibitor and that is susceptible to a second protease inhibitor; and (b) a second synTF polypeptide comprising a repressible protease (e.g., NS3) that is susceptible to a first protease inhibitor and that is resistant to a second protease inhibitor. Accordingly, presence of the first protease inhibitor can modulate the activity of the second synTF polypeptide but not the first synTF polypeptide, while the presence of the second protease inhibitor can modulate the activity of the first synTF polypeptide but not the second synTF polypeptide.

In some embodiments of any of the aspects, a repressible protease as described herein is sensitive to 1, 2, 3, 4, 5, or more different protease inhibitors as described herein. In some embodiments of any of the aspects, the NS3 protease comprises at least one of the following mutations: V36M, T54A, S122G, F43L, Q80K, S122R, D168Y, or any combination thereof. In some embodiments of any of the aspects, the NS3 protease comprises at least one of the following mutations: V36M, T54A, S122G, or any combination thereof; such a protease is also referred to herein as NS3$^{AI}$, as these mutations increase its sensitivity to asunaprevir (see e.g., SEQ ID NO: 254). In some embodiments of any of the aspects, the NS3 protease comprises at least one of the following mutations: F43L, Q80K, S122R, D168Y, or any combination thereof; such a protease is also referred to herein as NS3$^{TT}$, as these mutations increase its sensitivity to telaprevir (see e.g., SEQ ID NO: 255). See e.g., WO2019023164; Jacobs et al., StaPLs: versatile genetically encoded modules for engineering drug-inducible proteins, Nat Methods. 2018 July; 15(7): 523-526; the contents of each of each are incorporated herein by reference in their entireties.

NS3$^{AI}$; the V36M, T54A, S122G
mutations are shown in bold double
underlined text, respectively
SEQ ID NO: 254
APITAYAQQTRGLLGCIITSLTGRDKNQVEGEVQIMSTATQTFLATC

INGVCWAVYHGAGTRTIASPKGPVIQMYTNVDQDLVGWPAPQGSRSL

TPCTCGSSDLYLVTRHADVIPVRRRGDGRGSLLSPRPISYLKGSSGG

PLLCPAGHAVGLFRAAVCTRGVAKAVDFIPVENLETTMRSPVFTD,

NS3$^{TT}$; the F43L, Q80K, S122R,
D168Y mutations are shown in bold
double underlined text, respectively
SEQ ID NO: 255
APITAYAQQTRGLLGCIITSLTGRDKNQVEGEVQIVSTATQTLLATC

INGVCWAVYHGAGTRTIASPKGPVIQMYTNVIKDLVGWPAPQGSRSL

TPCTCGSSDLYLVTRHADVIPVRRRGIRRGSLLSPRPISYLKGSSGG

PLLCPAGHAVGLFRAAVCTRGVAKAVYFIPVENLETTMRSPVFTD,

In some embodiments of any of the aspects, the polypeptide further comprising a cofactor for the repressible protease. As used herein the term "cofactor for the repressible protease" refers to a molecule that increases the activity of the repressible protease. In some embodiments of any of the aspects, a synTF polypeptide as described herein comprises 1, 2, 3, 4, 5, or more cofactors for the repressible protease. In some embodiments of any of the aspects, the synTF polypeptide comprises one cofactor for each repressible protease. In embodiments comprising multiple cofactors for the repressible protease, the multiple cofactors for the repressible protease can be different individual cofactors or multiple copies of the same cofactor, or a combination of the foregoing.

In some embodiments of any of the aspects, the cofactor is an HSV NS4A domain, and the repressible protease is HSV NS3. The nonstructural protein 4a (NS4A) is the smallest of the nonstructural HCV proteins. The NS4A protein has multiple functions in the HCV life cycle, including (1) anchoring the NS3-4A complex to the outer leaflet of the endoplasmic reticulum and mitochondrial outer membrane, (2) serving as a cofactor for the NS3A serine protease, (3) augmenting NS3A helicase activity, and (4) regulating NS5A hyperphosphorylation and viral replication. The interactions between NS4A and NS4B control genome replication and between NS3 and NS4A play a role in virus assembly.

In some embodiments of any of the aspects, a synTF polypeptide as described herein comprises the portion of the NS4a polypeptide that serves as a cofactor for NS3. Deletion analysis has shown that the central region (approximately residues 21 to 34) of the 54-residue NS4A protein is essential and sufficient for the cofactor function of the NS3 serine protease. Accordingly, in some embodiments of any of the aspects, the repressible protease cofactor comprises a 14-residue region of the wildtype NS4A protein.

In some embodiments of any of the aspects, the cofactor for the repressible protease can be an HCV genotype 1 NS4A, an HCV genotype 1a NS4A, an HCV genotype 1b NS4A, an HCV genotype 2 NS4A, an HCV genotype 2a NS4A, an HCV genotype 2b NS4A, an HCV genotype 3 NS4A, an HCV genotype 3a NS4A, an HCV genotype 3b NS4A, an HCV genotype 4 NS4A, an HCV genotype 4a NS4A, an HCV genotype 4b NS4A, an HCV genotype 5 NS4A, an HCV genotype 5a NS4A, an HCV genotype 5b NS4A, an HCV genotype 6 NS4A, an HCV genotype 6a NS4A, an HCV genotype 6b NS4A, an HCV genotype 7 NS4A, an HCV genotype 7a NS4A, or an HCV genotype 7b NS4A. In some embodiments of any of the aspects, the cofactor for the repressible protease can be any known NS4A genotype, variant, or mutant, e.g., that maintains the same function. In some embodiments of any of the aspects, the NS4A sequence comprises residues 21-31 of the NS4A protein from HCV-H, HCV-1, HCV-J1, HCV-BK, HCV-JK1, HCV-J4, HCV-J, HCV-J6, C14112, HCV-J8, D14114, HCV-Nz11, or HCV-K3a (see e.g., Chao Lin 2006 supra; see e.g., Table 13).

In some embodiments of any of the aspects, the cofactor for a repressible protease of a synTF polypeptide as described herein comprises SEQ ID NOs: 48, 98, 137-156, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 48, 98, 137-156 that maintains the same functions as one of SEQ ID NOs: 48, 98, 137-156. In some embodiments of any of the aspects, the cofactor for a repressible protease of a synTF polypeptide as described herein comprises SEQ ID NOs: 81, 93, 96, 255-276, or an amino acid sequence that is at least 95% identical to the sequence of one of SEQ ID NOs: 81, 93, 96, 255-276 that maintains the same function.

In some embodiments of any of the aspects, the cofactor for the repressible protease of a synTF polypeptide as described herein comprises residues 1-14, 1-13, 1-12, 1-11, 1-10, 2-14, 2-13, 2-12, 2-11, 2-10, 3-14, 3-13, 3-12, 3-11, 3-10, 4-14, 4-13, 4-12, 4-11, or 4-10 of any of SEQ ID NOs: 81, 93, 96, 255-276.

NS4A (genotype 1A), 13 aa,
SEQ ID NO: 81
GCVVIVGRIVLSG,

-continued

NS4A domain (genotype 1a)
SEQ ID NO: 93
STWVLVGGVLAALAAYCLSTGCVVIVGRIVLS
GKPAIIPDREVLY, NS4 (with L6 linker in bold text)
SEQ ID NO: 96
STWVLVGGVLAALAAYCLSTGCVVIVGRIVLS
GKPAGSSGSSIIPDREVLY, NS4A domain,
SEQ ID NO: 106
IDTKYIMTCMSADLEVVTSTWVLVGGVLAALA
AYCLSTGCVVIVGRIVLSGKPAIIPDREVLY, SEQ ID NO: 256, NS4A (genotype 1B), 12 aa, GSV-VIVGRIILS; see e.g., Chain C, Nonstructural Protein, PDB: 4K8BC.

SEQ ID NO: 257, NS4A (genotype 1), 14 aa (see e.g., residues 1678-1691 of Hepatitis C virus genotype 1 polyprotein, NCBI Reference Sequence: NP_671491.1): GCV-VIVGRIVLSGK SEQ ID NO: 258, NS4A (genotype 2), 14 aa (see e.g., residues 1682-1695 of Hepatitis C virus genotype 2 polyprotein, NCBI Reference Sequence: YP_001469630.1: GCVCIIGRLHINQR SEQ ID NO: 259, NS4A (genotype 3), 14 aa (see e.g., residues 1684-1697 of Hepatitis C virus genotype 3 polyprotein, NCBI Reference Sequence: YP_001469631.1): GCVVIVGHIELEGK SEQ ID NO: 260, NS4A (genotype 4), 14 aa (see e.g., residues 1678-1691 of Hepatitis C virus genotype 4 polyprotein, NCBI Reference Sequence: YP_001469632.1): GSVVIVGRVVLSGQ SEQ ID NO: 261, NS4A (genotype 5), 14 aa (see e.g., residues 1679-1692 of Hepatitis C virus genotype 5 polyprotein, NCBI Reference Sequence: YP_001469633.1): GSVAIVGRIILSGR SEQ ID NO: 262, NS4A (genotype 6), 14 aa (see e.g., residues 1683-1696 of Hepatitis C virus genotype 6 polyprotein, NCBI Reference Sequence: YP_001469634.1): GCVVICGRIVTSGK SEQ ID NO: 263, NS4A (genotype 7), 14 aa (see e.g., residues 1682-1695 of Hepatitis C virus genotype 7 polyprotein, NCBI Reference Sequence: YP_009272536.1): GSVVVVGRVVLGSN In some embodiments of any of the aspects, the NS4A sequence is selected from Table 13. In one embodiment, the NS4A comprises residues 21-31 of SEQ ID NO: 264-276 or a sequence that is at least 70% identical.

TABLE 13

Exemplary NS4A sequences (see e.g., Chao Lin 2006 supra).
Residues 21-31 are bolded.

| SEQ ID NO | Genotype (strain) | Sequence |
|---|---|---|
| 264 | 1a (HCV-H) | STWVL VGGVL AALAA YCLST GCVVI VGRIV LSGKP AIIPD REVLY QEFDE MEEC |
| 265 | 1a (HCV-1) | STWVL VGGVL AALAA YCLST GCVVI VGRVV LSGKP AIIPD REVLY REFDE MEEC |
| 266 | 1a (HCV-J1) | STWVL VGGVL AALAA YCLST GCVVI VGRIV LSGRP AIIPD REVLY REFDE MEEC |
| 267 | 1b (HCV-BK) | STWVL VGGVL AALAA YCLTT GSVVI VGRII LSGRP AIVPD RELLY QEFDE MEEC |
| 268 | 1b (HCV-JK1) | STWVL VGGVL AALAA YCLTT GSVVI VGRII LSGRP AIIPD RELLY QEFDE MEEC |
| 269 | 1b (HCV-J4) | STWVL VGGVL AALAA YCLTT GSVVI VGRII LSGKP AVVPD RELLY QEFDE MEEC |
| 270 | 1b (HCV-J) | STWVL VGGVL AALAA YCLTT GSVVI VGRII LSGRP AVIPD RELLY REFDE MEEC |
| 271 | 2a (HCV-J6) | STWVL AGGVL AAVAA YCLAT GCVCI IGRLH VNQRA VVAPD KEVLY EAFDE MEEC |
| 272 | 2a (D14112) | STWVL AGGVL AAVAA YCLAT GCVSI IGRLH INGRA VVAPD KEVLY EAFDE MEEC |
| 273 | 2b (HCV-J8) | SSWVL AGGVL AAVAA YCLAT GCISI IGRLH LNDRV VVAPD KEILY EAFDE MEEC |
| 274 | 2b (D14114) | STWVL AGGVL AAVAA YCLAT GCVSI IGRLH LNDQV VVTPD KEILY EAFDE MEEC |
| 275 | 3a (HCV-Nz11) | STWVL LGGVL AALAA YCLSV GCVVI VGHIE LEGKP ALVPD KEVLY QQYDE MEEC |
| 276 | 3a (HCV-K3a) | STWVL LGGVL AAVAA YCLSV GCVVI VGHIE LGGKP ALVPD KEVLY QQYDE MEEC |

In some embodiments of any of the aspects, a synTF polypeptide as described herein can comprise any combination of NS3 and NS4A genotypes, variants, or mutants as described herein. In one embodiment, the NS3 and NS4A are selected from selected from the same genotype as each other. In some embodiments of any of the aspects, the NS3 is genotype 1a and the NS4A is genotype 1b. In some embodiments of any of the aspects, the NS3 is genotype 1b and the NS4A is genotype 1a.

In some embodiments of any of the aspects, a synTF polypeptide as described herein comprises an HSV NS4A domain adjacent to the NS3 repressible protease. In some embodiments of any of the aspects, the NS4A domain is N-terminal of the NS3 repressible protease. In some embodiments of any of the aspects, the NS4A domain is C-terminal of the NS3 repressible protease. In some embodiments of any of the aspects, the synTF polypeptide comprises a peptide linker between the NS4A domain and the NS3 repressible protease. Non-limiting examples of linker (e.g., between the NS4A domain and the NS3 repressible protease) include: SGTS (SEQ ID NO: 277) and GSGS (SEQ ID NO: 278).

In some embodiments of any of the aspects, any two domains as described herein in a synTF polypeptide can be joined into a single polypeptide by positioning a peptide linker, e.g., a flexible linker between them. As used herein "peptide linker" refers to an oligo- or polypeptide region from about 2 to 100 amino acids in length, which links together any of the sequences of the polypeptides as described herein. In some embodiment, linkers can include or be composed of flexible residues such as glycine and serine so that the adjacent protein domains are free to move relative to one another. Longer linkers may be used when it is desirable to ensure that two adjacent domains do not sterically interfere with one another. Linkers may be cleavable or non-cleavable.

Described herein are synTF polypeptides comprising protease cleavage sites. As used herein, the term "protease cleavage site" refers to a specific sequence or sequence motif recognized by and cleaved by the repressible protease. A cleavage site for a protease includes the specific amino acid sequence or motif recognized by the protease during proteolytic cleavage and typically includes the surrounding one to six amino acids on either side of the scissile bond, which bind to the active site of the protease and are used for recognition as a substrate. In some embodiments of any of the aspects, the protease cleavage site can be any site specifically bound by and cleaved by the repressible protease. In some embodiments of any of the aspects, a synTF polypeptide as described herein (or the synTF polypeptide system collectively) comprises 1, 2, 3, 4, 5, or more protease cleavage sites. In some embodiments of any of the aspects, the synTF polypeptide comprises two protease cleavage sites. In embodiments comprising multiple protease cleavage sites, the multiple protease cleavage sites can be different individual protease cleavage sites or multiple copies of the same protease cleavage sites, or a combination of the foregoing.

As a non-limiting example, during HCV replication, the NS3-4A serine protease is responsible for the proteolytic cleavage at four junctions of the HCV polyprotein precursor: NS3/NS4A (self-cleavage), NS4A/NS4B, NS4B/NS5A, and NS5A/NS5B. Accordingly, the protease cleavage site of a synTF polypeptide as described herein can be a NS3/NS4A cleavage site, a NS4A/NS4B cleavage site, a NS4B/NS5A cleavage site, or a NS5A/NS5B cleavage site. The protease cleavage site can be a protease cleavage sites from HCV genotype 1, genotype 1a, genotype 1b, genotype 2, genotype 2a, genotype 2b, genotype 3, genotype 3a, genotype 3b, genotype 4, genotype 4a, genotype 4b, genotype 5, genotype 5a, genotype 5b, genotype 6, genotype 6a, genotype 6b, genotype 7, genotype 7a NS4A, or genotype 7b. In some embodiments of any of the aspects, the protease cleavage site can be any known NS3/NS4A protease cleavage site or variant or mutant thereof, e.g., that maintains the same function. In some embodiments of any of the aspects, the NS4A sequence comprises residues 21-31 of the NS4A protein from HCV-H, HCV-1, HCV-J1, HCV-BK, HCV-JK1, HCV-J4, HCV-J, HCV-J6, C14112, HCV-J8, D14114, HCV-Nz11, or HCV-K3a (see e.g., Chao Lin 2006 supra).

In some embodiments of any of the aspects, the protease cleavage site of a synTF polypeptide as described herein comprises SEQ ID NOs: 78, 83, 87, 279-301, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 78, 83, 87, 279-301 that maintains the same function.

In some embodiments of any of the aspects, the protease cleavage site of a synTF polypeptide as described herein comprises residues 1-20, 1-19, 1-18, 1-17, 1-16, 1-15, 2-20, 2-19, 2-18, 2-17, 2-16, 2-15, 3-20, 3-19, 3-18, 3-17, 3-16, 3-15, 4-20, 4-19, 4-18, 4-17, 4-16, 4-15, 5-20, 5-19, 5-18, 5-17, 5-16, or 5-15, of any of SEQ ID NOs: 78, 83, 87, 279-301.

```
NS5A/5B cut site (CC), 10 aa,
                                        SEQ ID NO: 78
EDVVCCHSIY, NS4A/4B cut site (CS), 14 aa,
                                        SEQ ID NO: 83
LYQEFDEMEECSQH, N3 cleavage site (NS4A/4B cut site),
                                        SEQ ID NO: 87
DEMEECSQHL,

SEQ ID NO: 279
QEFEDVVPCSMGS,

NS5A/5B cut site,
                                        SEQ ID NO: 280
EDVVCCHSI, NS4A/4B cut site,
                                        SEQ ID NO: 281
DEMEECSQH,
```

TABLE 14

Exemplary NS3/NS4A protease cleavage sites (see e.g., Chao Lin 2006 supra).

| Cleavage Site Type | SEQ ID NO | Genotype (Strain) | Sequence (cleavage site shown with space) |
|---|---|---|---|
| NS3/NS4A | 282 | 1a (HCV-H) | CMSADLEVVT STWVLVGGVL |
|  | 283 | 1b (HCV-BK) | CMSADLEVVT STWVLVGGVL |
|  | 284 | 2a (HCV-J6) | CMQADLEVMT STWVLAGGVL |
|  | 285 | 2b (HCV-J8) | CMQADLEIMT SSWVLAGGVL |
|  | 286 | 3a (HCV-Nz11) | CMSADLEVTT STWVLLGGVL |
| NS4A/NS4B | 287 | 1a (HCV-H) | YQEFDEMEEC SQHLPYIEQG |
|  | 288 | 1b (HCV-BK) | YQEFDEMEEC ASHLPYIEQG |
|  | 289 | 2a (HCV-J6) | YEAFDEMEEC ASRAALIEEG |
|  | 290 | 2b (HCV-J8) | YEAFDEMEEC ASKAALIEEG |
|  | 291 | 3a (HCV-Nz11) | YQQYDEMEEC SQAAPYIEQA |
| NS4B/NS5A | 292 | 1a (HCV-H) | WISSECTTPC SGSWLRDVWD |
|  | 293 | 1b (HCV-BK) | WINEDCSTPC SGSWLRDVWD |
|  | 294 | 2a (HCV-J6) | WITEDCPIPC SGSWLRDVWD |
|  | 295 | 2b (HCV-J8) | WITEDCPVPC SGSWLQDIWD |
|  | 296 | 3a (HCV-Nz11) | WINEDYPSPC SDDWLRTIWD |
| NS5A/NS5B | 297 | 1a (HCV-H) | GADTEDVVCC SMSYSWTGAL |
|  | 298 | 1b (HCV-BK) | EEASEDVVCC SMSYTWTGAL |
|  | 299 | 2a (HCV-J6) | SEEDDSVVCC SMSYSWTGAL |

TABLE 14-continued

Exemplary NS3/NS4A protease cleavage sites
(see e.g., Chao Lin 2006 supra).

| Cleavage Site Type | SEQ ID NO | Genotype (Strain) | Sequence (cleavage site shown with space) |
|---|---|---|---|
| | 300 | 2b (HCV-J8) | SDQEDSVICC SMSYSWTGAL |
| | 301 | 3a (HCV-Nz11) | DSEEQSVVCC SMSYSWTGAL |

In some embodiments of any of the aspects, a synTF polypeptide as described herein comprises two protease cleavage sites, with one N-terminal of the NS3-NS4A complex, and the other C-terminal of the NS3-NS4A complex (see e.g., Table 15). In some embodiments of any of the aspects, the two protease cleavage sites can be the same cleavage sites or different cleavage sites.

TABLE 15

Exemplary Protease Cleavage Site Combinations.

| N | 3/4A | | | | 4A/4B | | | |
|---|---|---|---|---|---|---|---|---|
| C | 3/4A | 4A/4B | 4B/5A | 5A/5B | 3/4A | 4A/4B | 4B/5A | 5A/5B |
| N | 4B/5A | | | | 5A/5B | | | |
| C | 3/4A | 4A/4B | 4B/5A | 5A/5B | 3/4A | 4A/4B | 4B/5A | 5A/5B |

"N" indicates N-terminal of the NS3-NS4A complex.
"C" indicates C-terminal of the NS3-NS4A complex.
"3/4A" indicates the NS3/NS4A cleavage site.
"4A/4B" indicates the NS4A/NS4B cleavage site.
"4B/5A" indicates the NS4B/NS5A cleavage site.
"5A/5B" indicates the NS5A/NS5B cleavage site.

In some embodiments of any of the aspects, a synTF polypeptide as described herein comprise any known genotypes, variants, or mutants of NS3/NS4A, NS4A/NS4B, NS4B/NS5A, and NS5A/NS5B cleavage sites. In one embodiment, the two protease cleavage sites are selected from selected from the same genotype as each other.

In some embodiments of any of the aspects, the protease cleavage site is located or engineered such that, when the synTF cleaves itself using the repressible protease in the absence of a protease inhibitor, the resulting amino acid at the N-terminus of the newly cleaved polypeptide(s) causes the polypeptide(s) to degrade at a faster rate and have a shorter half-life comp -continued SEQ ID NO: 102, NS3 domain, comprising: NS3 cleavage sites (SEQ ID NOs: 78 and 83, double underlined text), N-end rule (SEQ ID NO: 79, bold text), AU1 tag (SEQ ID NO: 80, *italicized text*), NS4A (SEQ ID NO: 81, *bold italicized text*), and NS3 protease (SEQ ID NO: 82, *italicized double underlined text*):
EDVVCCHSIYGKKKGDI*DTYTYI*GSSGT*GCVVIVGRIVLSG*SGTSAPITAYAQQTRGLLGCHTSLTGR

DKNQVEGEVQIVSTATQTFLATCINGVCWAVYHGAGTRTIASPKGPVIQMYTNVDQDLVGWPAPQGSR

SLTPCTCGSSDLYLVTRHADVIPVRRRGDSRGSLLSPRPISYLKGSSGGPLLCPAGHAVGLFRAAVCT

RGVAKAVDFIPVENLETTMRSPVFTDNSSPPAVTLTHPITKIDREVLYQEFDEMEECSQH,

In some embodiments of any of the aspects, the synTF comprises a stabilizable polypeptide linkage (StaPL) domain. In some embodiments of any of the aspects, the StaPL domain comprises NS4A, the NS3 protease domain, and a portion of the NS3 helicase domain. In some embodiments of any of the aspects, the partial NS3 helicase domain comprises SEQ ID NOs: 92, 105, 302, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 92, 105, 302.

NS3 Partial Helicase Domain,
SEQ ID NO: 92
NSSPPAVTLTHPITKIDTKYIMTCMSADLEVVT,

NS3 Partial Helicase Domain,
SEQ ID NO: 105
NSSPPAVTLTHPITK,

NS3 partial helicase domain,
SEQ ID NO: 302
NSSPPAVTLTH,

In some embodiments of any of the aspects, the StaPL domain further comprises a protease cleavage site at the N terminus, e.g., selected from EDVVCCHSI (SEQ ID NO: 280) or DEMEECSQH (SEQ ID NO: 281), directly linked or indirectly linked through a peptide linker. In some embodiments of any of the aspects, the StaPL domain comprises SEQ ID NOs: 304-306, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 304-306.

SEQ ID NO: 304 StaPL domain, comprising: NS4A (SEQ ID NO: 81, *bold italicized text*), and NS3 protease (SEQ ID NO: 82, *italicized text*); linkers (SEQ ID NOs: 277 and 303, double underlined text); NS3 helicase (SEQ ID NO: 302, *bold italicized double underlined text*
T*GCVVIVGRIVLSG*SGTSAPITAYAQQTRGLLGCIITSLTGRDKNQVEGEVQIVSTATQTFLATCINGVC

WAVYHGAGTRTIASPKGPVIQMYTNVDQDLVGWPAPQGSRSLTPCTCGSSDLYLVTRHADVIPVRRRG

DSRGSLLSPRPISYLKGSSGGPLLCPAGHAVGLFRAAVCTRGVAKAVDFIPVENLETTMRSPVFTD*NSSP*

*PAVTLTH*GSGGS

In some embodiments of any of the aspects, StaPL domain comprises a repressible protease that comprises at least one mutation that increases its sensitivity to at least one protease inhibitor. In some embodiments of any of the aspects, the NS3 protease (e.g., of the StaPL domain) comprises at least one of the following mutations: V36M, T54A, S122G, F43L, Q80K, S122R, D 168Y, or any combination thereof. In some embodiments of any of the aspects, the NS3 protease (e.g., of the StaPL domain) comprises at least one of the following mutations: V36M, T54A, S122G, or any combination thereof; such a StaPL is also referred to herein as StaPL$^{AI}$, as these mutations increase its sensitivity to asunaprevir (see e.g., SEQ ID NO: 254, 305). In some embodiments of any of the aspects, the NS3 protease (e.g., of the StaPL domain) comprises at least one of the following mutations: F43L, Q80K, S122R, D168Y, or any combination thereof; such a protease is also referred to herein as StaPL$^{TI}$, as these mutations increase its sensitivity to telaprevir, (see e.g., SEQ ID NO: 255, 306).

SEQ ID NO: 305, StaPL^AI domain, comprising:
NS4A (SEQ ID NO: 81, **bold *italicized text***),
and NS3 protease (SEQ ID NO: 82, *italicized text*); linkers (SEQ ID NOs: 277 and 303, <u>double underlined text</u>); NS3 helicase (SEQ ID NO: 302, *<u>bold italicized double underlined text</u>*); the V36M, T54A, S122G mutations are shown in <u>bold double underlined text</u>, respectively.
T*GCVVIVGRIVLSG*<u>SGTS</u>*APITAYAQQTRGLLGCIITSLTGRDKNQVEGEVQI*MSTATQTFLATCINGVC
WAVYHGAGTRTIASPKGPVIQMYTNVDQDLVGWPAPQGSRSLTPCTCGSSDLYLVTRHADVIPVRRRG DGRGSLLSPRPISYLKGSSGGPLLCPAGHAVGLFRAAVCTRGVAKAVFIPVENLETTMRSPVFTD<u>NSS</u>

<u>PPAVTLTH</u>GGSGGS

SEQ ID NO: 306, StaPL^II domain, comprising: NS4A (SEQ ID NO: 81, **bold *italicized text***),
and NS3 protease (SEQ ID NO: 82, *italicized text*); linkers (SEQ ID NOs: 277 and 303, <u>double underlined text</u>); NS3 helicase (SEQ ID NO: 302, *<u>bold italicized double underlined text</u>*); the F43L, Q80K, S122R, D168Y mutations are shown in <u>bold double underlined text</u>, respectively.
T*GCVVIVGRIVLSG*<u>SGTS</u>*APITAYAQQTRGLLGCIITSLTGRDKNQVEGEVQIVSTATQT*LLATCINGVC

W*AVYHGAGTRTIASPKGPVIQMYTNVD*KDLVGWPAPQGSRSLTPCTCGSSDLYLVTRHADVIPVRRRG

DRRGSLLSPRP

-continued

SEQ ID NO: 311, soluble NS3/NS4A, 197 aa
MKKKGSVVIVGRINLSGDTAYAQQTRGEEGCQETSQTGRDKNQVEGEVQIVSTATQTFLATCIN

GVCWTVYHGAGTRTIASPKGPVTQMYTNVDKDLVGWQAPQGSRSLTPCTCGSSDLYLVTRHA

DVIPVRRRGDSRGSLLSPRPISYLKGSSGGPLLCPAGHAVGIFRAAVCTRGVAKAVDFIPVESLET

TMRSP

SEQ ID NO: 312, soluble NS3/NS4A, 197 aa
MKKKGSVVIVGRINLSGDTAYAQQTRGEEGCQETSQTGRDKNQVEGEVQIVSTATQTFLATSIN

GVLWTVYHGAGTRTIASPKGPVTQMYTNVDKDLVGWQAPQGSRSLTPCTCGSSDLYLVTRHAD

VIPVRRRGDSRGSLLSPRPISYLKGSSGGPLLCPAGHAVGIFRAAVSTRGVAKAVDFIPVESLETT

MRSP

SEQ ID NO: 313, soluble NS3/NS4A, 197 aa
MKKKGSVVIVGRINLSGDTAYAQQTRGEQGCQKTSHTGRDKNQVEGEVQIVSTATQTFLATSIN

GVLWTVYHGAGTRTIASPKGPVTQMYTNVDKDLVGWQAPQGSRSLTPCTCGSSDLYLVTRHAD

VIPVRRRGDSRGSLLSPRPISYLKGSSGGPLLCPAGHAVGIFRAAVSTRGVAKAVDFIPVESLETT

MRSP

SEQ ID NO: 314, soluble NS3/NS4A, 197 aa
MKKKGSVVIVGRINLSGDTAYAQQTRGEQGTQKTSHTGRDKNQVEGEVQIVSTATQTFLATSIN

GVLWTVYHGAGTRTIASPKGPVTQMYTNVDKDLVGWQAPQGSRSLTPCTCGSSDLYLVTRHAD

VIPVRRRGDSRGSLLSPRPISYLKGSSGGPLLCPAGHAVGIFRAAVSTRGVAKAVDFIPVESLETT

MRSP

SEQ ID NO: 315, NS3aH1, soluble NS3/NS4A (S139A), 196 aa
KKKGSVVIVGRINLSGDTAYAQQTRGEEGCQETSQTGRDKNQVEGEVQIVSTATQTFLATSINGV

LWTVYHGAGTRTIASPKGPVTQMYTNVDKDLVGWQAPQGSRSLTPCTCGSSDLYLVTRHADVI

PVRRRGDSRGSLLSPRPISYLKGSAGGPLLCPAGHAVGIFRAAV STRGVAKAVDFIPVES-
LETTMR

SP

In some embodiments of any of the aspects, the repressible protease comprises mutations to increase binding affinity for a specific ligand. As a non-limiting example, NS3aH1 (e.g., SEQ ID NO: 315) comprises four mutations needed for interaction with the ANR peptide (e.g., SEQ ID NO: 316, GELDELVYLLDGPGYDPIHSD): A7S, E13L, I35V and T42S. Accordingly, in some embodiments of any of the aspects, a repressible protease as described herein comprises at least one of the following mutations: A7S, E13L, I35V and T42S, or any combination thereof.

In some embodiments of any of the aspects, a synTF polypeptide as described herein is in combination with a protease inhibitor. As used herein, "in combination with" refers to two or more substances being present in the same formulation in any molecular or physical arrangement, e.g., in an admixture, in a solution, in a mixture, in a suspension, in a colloid, in an emulsion. The formulation can be a homogeneous or heterogeneous mixture. In some embodiments of any of the aspects, the active compound(s) can be comprised by a superstructure, e.g., nanoparticles, liposomes, vectors, cells, scaffolds, or the like, said superstructure is which in solution, mixture, admixture, suspension, etc., with the synTF polypeptide or synTF polypeptide system. In some embodiments of any of the aspects, the synTF polypeptide is bound to a protease inhibitor bound to the repressible protease. In some embodiments of any of the aspects, the synTF polypeptide is bound specifically to a protease inhibitor bound to the repressible protease.

In some embodiments of any of the aspects, the synTF polypeptide is in combination with 1, 2, 3, 4, 5, or more protease inhibitors. In some embodiments of any of the aspects, the synTF polypeptide is in combination with one protease inhibitor. In embodiments comprising multiple protease inhibitors, the multiple protease inhibitors can be different individual protease inhibitors or multiple copies of the same protease inhibitor, or a combination of the foregoing.

In some embodiments of any of the aspects, the protease inhibitor is grazoprevir (abbreviated as GZV or GZP; see e.g., PubChem CID: 44603531). In some embodiments of any of the aspects, the protease inhibitor is danoprevir (DNV; see e.g., PubChem CID: 11285588). In some embodiments of any of the aspects, the protease inhibitor is an approved NS3 protease inhibitor, such as but not limited to grazoprevir, danoprevir, simeprevir, asunaprevir, ciluprevir, boceprevir, sovaprevir, paritaprevir, ombitasvir, paritaprevir, ritonavir, dasabuvir, and telaprevir. Additional non-limiting examples of NS3 protease inhibitors are listed in Table 16 (see e.g., McCauley and Rudd, Hepatitis C virus NS3/4a protease inhibitors, Current Opinion in Pharmacology 2016, 30:84-92; the content of which is incorporated herein by reference in its entirety).

TABLE 16
Exemplary NS3/NS4A protease inhibitors
| Description or Name(s) | Structure |
|---|---|
| The N-terminal hexapeptide product of substrate cleavage (e.g., DDIVPC-OH) | 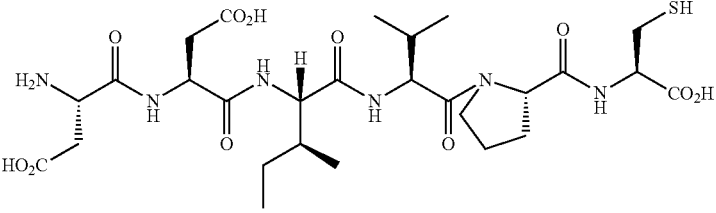<br>1 |
| One of the products of cleavage of the NS4a-NS4b peptide (e.g., Ac-DEMEEC-OH) | 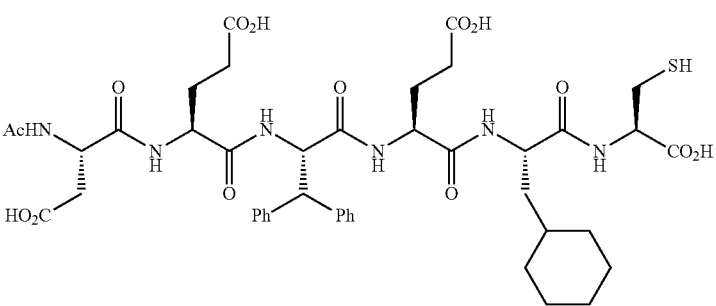<br>2 |
| VICTRELIS ™ boceprevir SCH503034 | 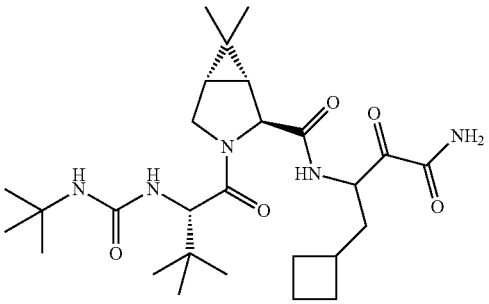 [SMILES: CC(C)(C)NC(=O)N[C@H](C(=O)N1C[C@H]2[C@@H]([C@H]1C(=O)NC(CC1CCC1)C(=O)C(N)=O)C2(C)C)C(C)(C)C] |
| INCIVEK ™, INCIVIO ™, telaprevir, VX-950 | 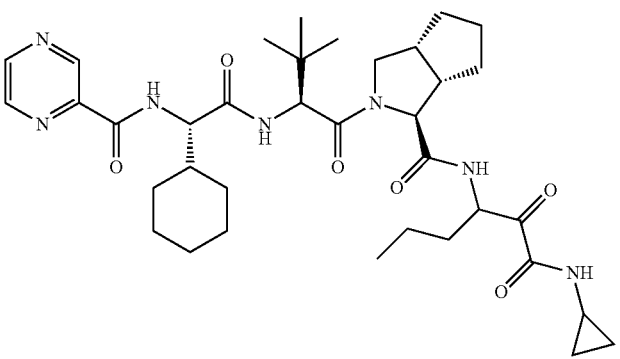 [SMILES: CCCC(NC(=O)[C@@H]1[C@H]2CCC[C@H]2CN1C(=O)[C@@H](NC(=O)[C@@H](NC(=O)c1cnccn1)C1CCCCC1)C(C)(C)C)C(=O)C(=O)NC1CC1] |

TABLE 16-continued
Exemplary NS3/NS4A protease inhibitors
| Description or Name(s) | Structure |
| --- | --- |
| Ciluprevir; BILN-2061 | 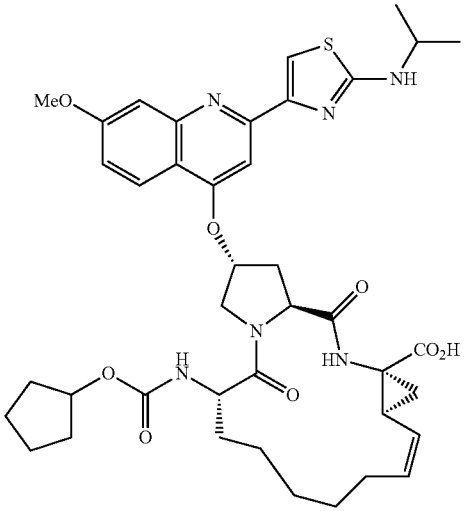 [SMILES: COc1ccc2c(O[C@@H]3C[C@H]4C(=O)N[C@]5(C(=O)O)C[C@H]5/C=C\CCCCC[C@H](NC(=O)OC5CCCC5)C(=O)N4C3)cc(-c3csc(NC(C)C)n3)nc2c1] |
| BMS-605339 | 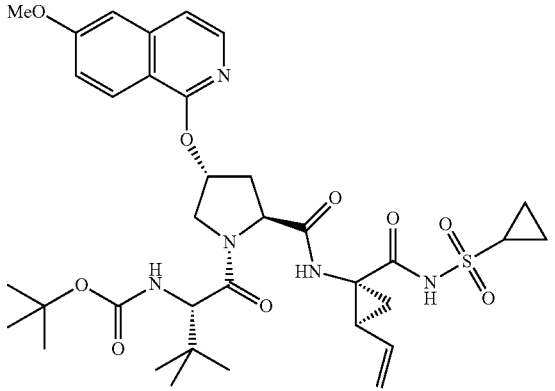 |
| MK-4519 | 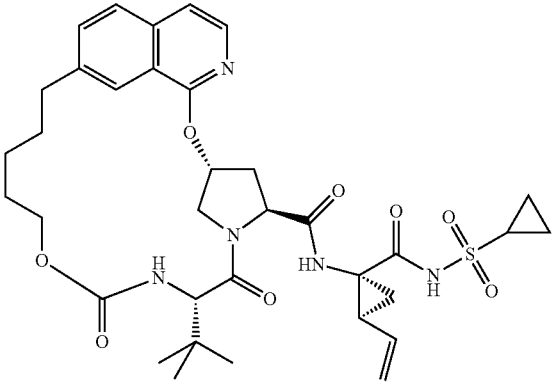 [SMILES: C=C[C@@H]1C[C@]1(NC(=O)[C@@H]1C[C@@H]2CN1C(=O)[C@H](C(C)(C)C)NC(=O)OCCCCCc1ccc3ccnc(c3c1)O2)C(=O)NS(=O)(=O)C1CC1] |

TABLE 16-continued

Exemplary NS3/NS4A protease inhibitors

| Description or Name(s) | Structure |
|---|---|
| faldaprevir, BI-201335 | 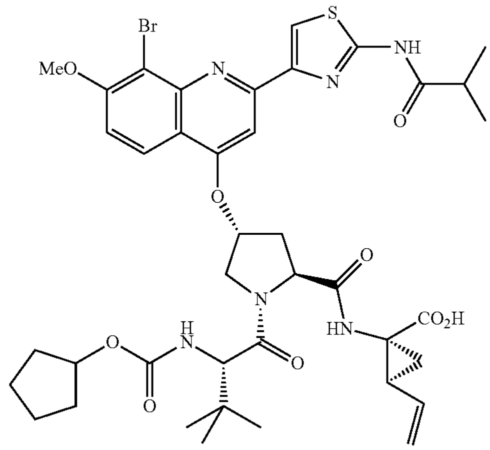 |
| Danoprevir, ITMN-191, R7227 | 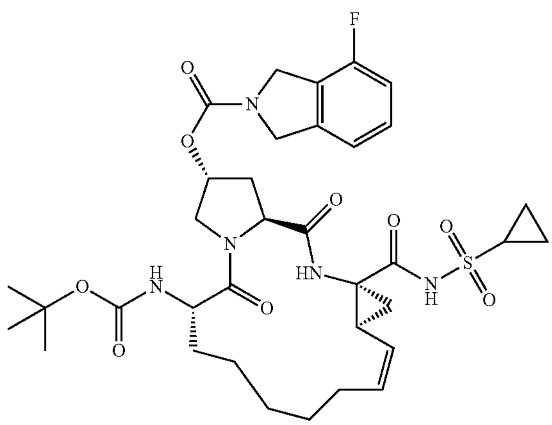 [SMILES: CC(C)(C)OC(=O)N[C@H]1CCCCC/C=C\[C@@H]2C[C@@]2(C(=O)NS(=O)(=O)C2CC2)NC(=O)[C@@H]2C[C@@H](OC(=O)N3Cc4cccc(F)c4C3)CN2C1=O] |
| SUNVEPRA ™, asunaprevir, BMS-650032 | 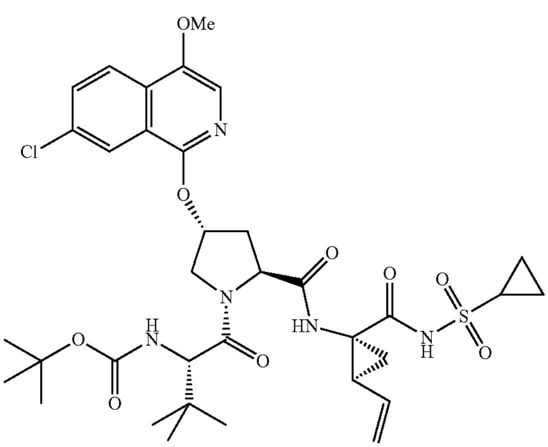 |

TABLE 16-continued
Exemplary NS3/NS4A protease inhibitors
| Description or Name(s) | Structure |
|---|---|
| VANIHEP ™, vaniprevir, MK-7009 | 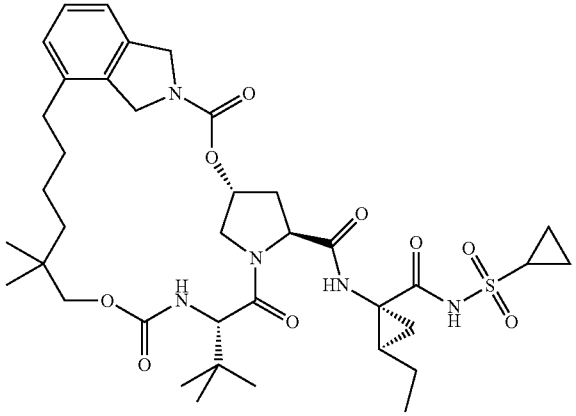 [SMILES: CC[C@@H]1C[C@]1(NC(=O)[C@@H]1C[C@@H]2CN1C(=O)[C@H](C(C)(C)C)NC(=O)OCC(C)(C)CCCCc1cccc3c1CN(C3)C(=O)O2)C(=O)NS(=O)(=O)C1CC1] |
| OLYSIO ™, simeprevir, TMC-435350 | 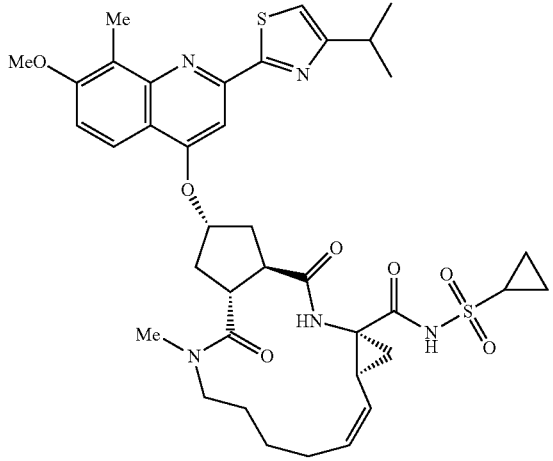 [SMILES: COc1ccc2c(O[C@@H]3C[C@H]4C(=O)N[C@]5(C(=O)NS(=O)(=O)C6CC6)C[C@H]5/C=C\CCCCN(C)C(=O)[C@@H]4C3)cc(-c3nc(C(C)C)cs3)nc2c1C] |
| Sovaprevir, ACH-1625 | 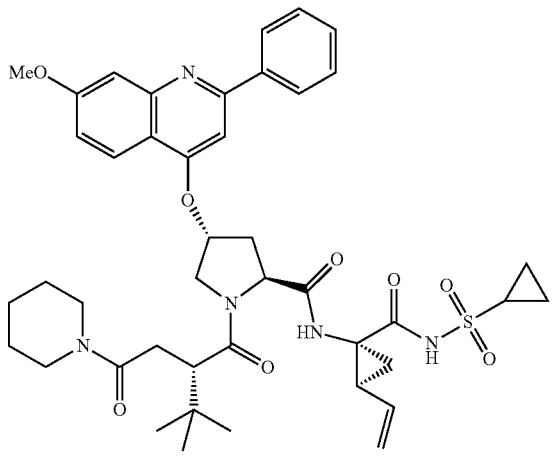 [SMILES: C=C[C@@H]1C[C@]1(NC(=O)[C@@H]1C[C@@H](Oc2cc(-c3ccccc3)nc3cc(OC)ccc23)CN1C(=O)[C@@H](CC(=O)N1CCCCC1)C(C)(C)C)C(=O)NS(=O)(=O)C1CC1] |

TABLE 16-continued

Exemplary NS3/NS4A protease inhibitors

| Description or Name(s) | Structure |
|---|---|
| Deldeprevir/neceprevir, ACH-2684 | 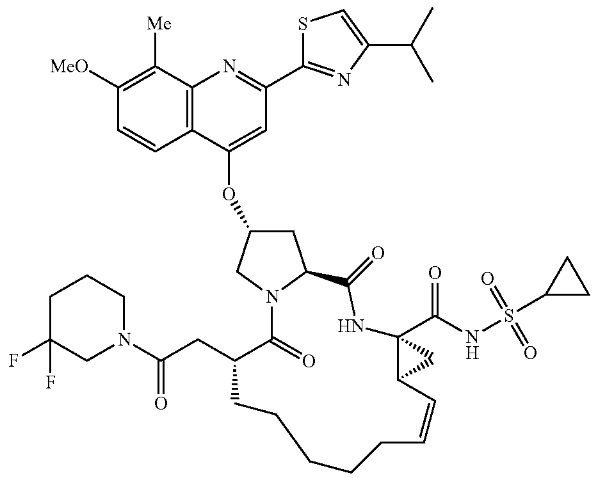 [SMILES: COc1ccc2c(O[C@@H]3C[C@H]4C(=O)N[C@]5(C(=O)NS(=O)(=O)C6CC6)C[C@H]5/C=C\CCCCC[C@H](CC(=O)N5CCCC(F)(F)C5)C(=O)N4C3)cc(-c3nc(C(C)C)cs3)nc2c1C] |
| IDX320 | 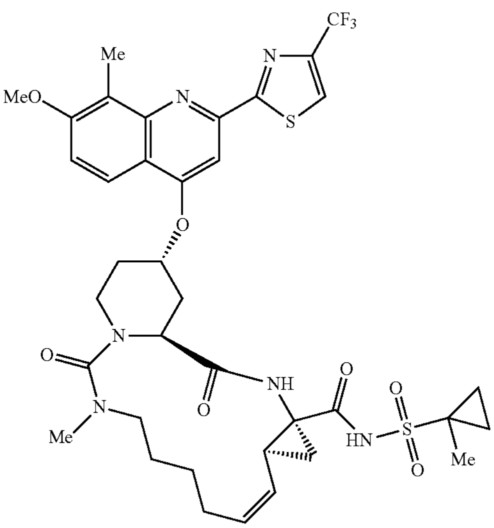 [SMILES: COc1ccc2c(O[C@H]3CCN4C(=O)N(C)CCCC/C=C\[C@@H]5C[C@@]5(C(=O)NS(=O)(=O)C5(C)CC5)NC(=O)[C@@H]4C3)cc(-c3nc(C(F)(F)F)cs3)nc2c1C] |
| GS-9256 | 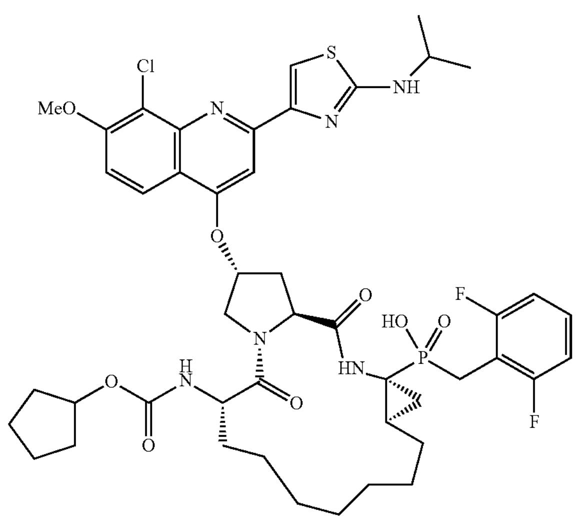 |

TABLE 16-continued

Exemplary NS3/NS4A protease inhibitors

| Description or Name(s) | Structure |
|---|---|
| PHX1766 | 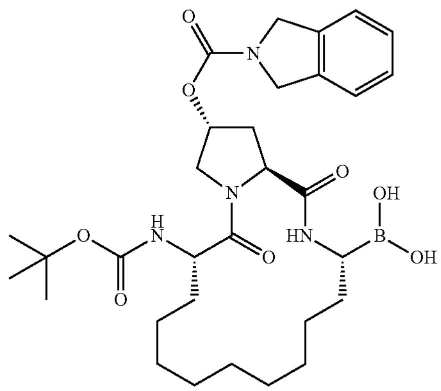 [SMILES: CC(C)(C)OC(=O)N[C@H]1CCCCCCCCC[C@@H](B(O)O)NC(=O)[C@@H]2C[C@@H](OC(=O)N3Cc4ccccc4C3)CN2C1=O] |
| MK-2748 | 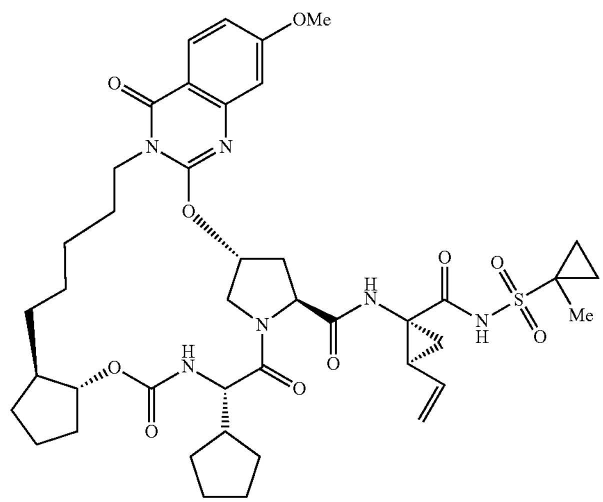 [SMILES: C=C[C@@H]1C[C@]1(NC(=O)[C@@H]1C[C@@H]2CN1C(=O)[C@H](C1CCCC1)NC(=O)O[C@@H]1CCC[C@H]1CCCCCn1c(nc3cc(OC)ccc3c1=O)O2)C(=O)NS(=O)(=O)C1(C)CC1] |
| Vedrorevir, GS-9451, GS-9451 | 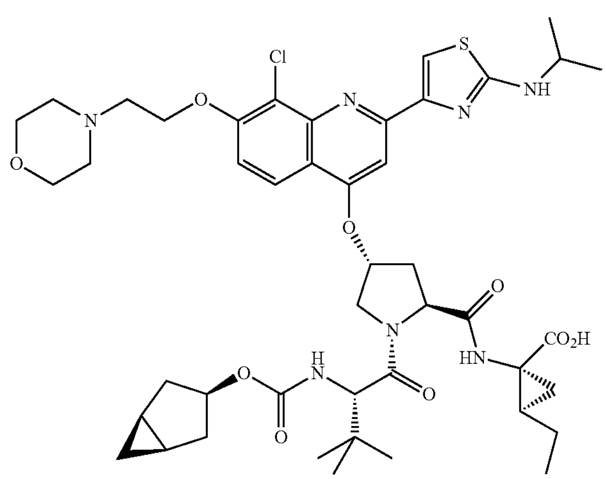 |

TABLE 16-continued

Exemplary NS3/NS4A protease inhibitors

| Description or Name(s) | Structure |
| --- | --- |
| MK-6325 | 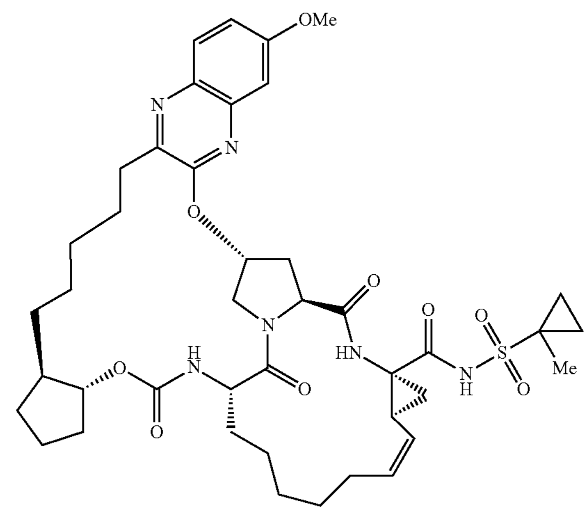 [SMILES: COc1ccc2nc3c(nc2c1)O[C@@H]1C[C@H]2C(=O)N[C@]4(C(=O)NS(=O)(=O)C5(C)CC5)C[C@H]4/C=C\CCCCC[C@H](NC(=O)O[C@@H]4CCC[C@H]4CCCCC3)C(=O)N2C1] |
| MK-8831 | 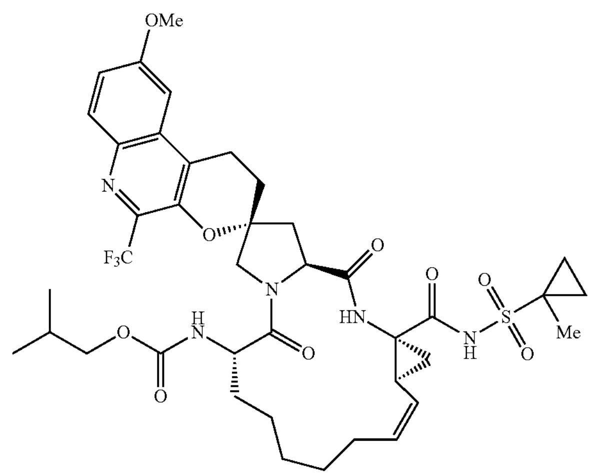 [SMILES: COc1ccc2nc(C(F)(F)F)c3c(c2c1)CC[C@]1(C[C@H]2C(=O)N[C@]4(C(=O)NS(=O)(=O)C5(C)CC5)C[C@H]4/C=C\CCCCC[C@H](NC(=O)OCC(C)C)C(=O)N2C1)O3] |
| VIKERA PAK ™, paritaprevir, ABT-450 | 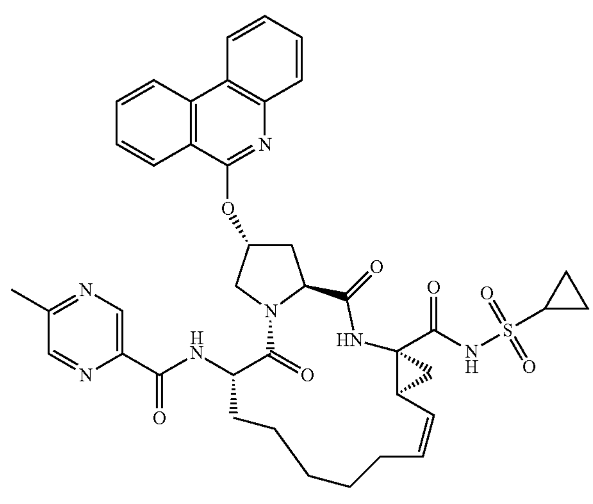 |

TABLE 16-continued

Exemplary NS3/NS4A protease inhibitors

| Description or Name(s) | Structure |
| --- | --- |
| ZEPATIER™, grazoprevir, MK-5172 | 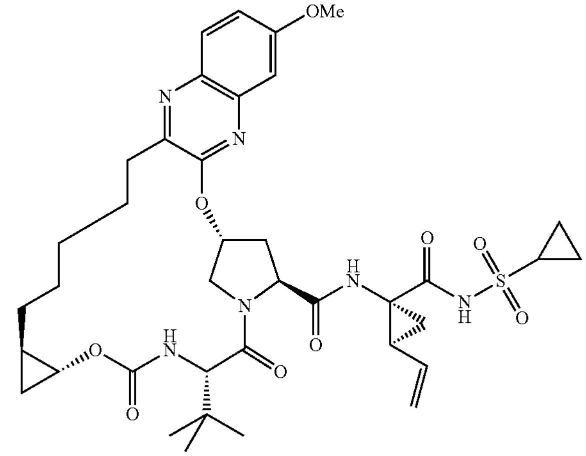 [SMILES: C=C[C@@H]1C[C@]1(NC(=O)[C@@H]1C[C@@H]2CN1C(=O)[C@H](C(C)(C)C)NC(=O)O[C@@H]1C[C@H]1CCCCCc1nc3ccc(OC)cc3nc1O2)C(=O)NS(=O)(=O)C1CC1] |
| Glecaprevir, ABT-493 | 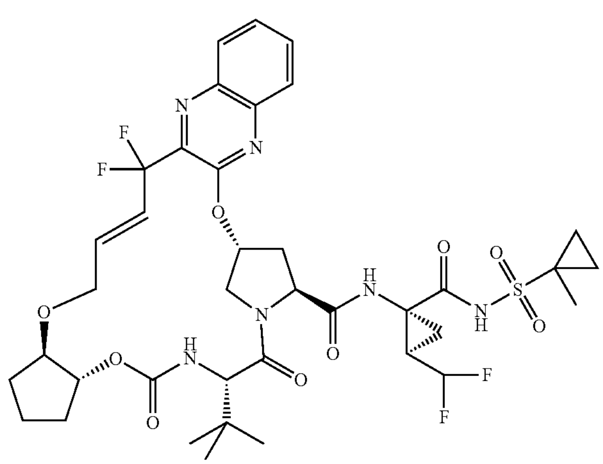 [SMILES: CC(C)(C)[C@@H]1NC(=O)O[C@@H]2CCC[C@H]2OC/C=C/C(F)(F)c2nc3ccccc3nc2O[C@@H]2C[C@@H](C(=O)N[C@]3(C(=O)NS(=O)(=O)C4(C)CC4)C[C@H]3C(F)F)N(C2)C1=O] |
| Voxilaprevir, GS-9857 | 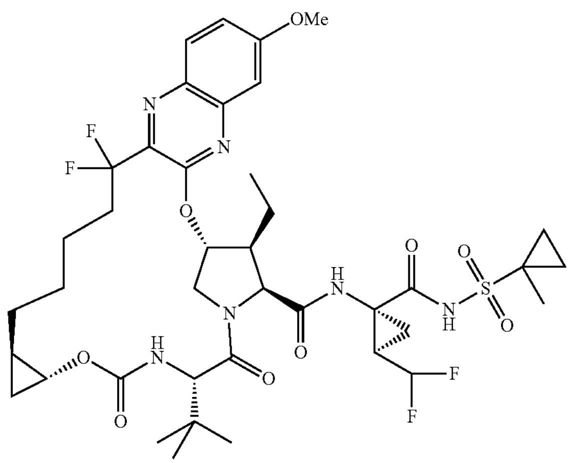 [SMILES: CC[C@@H]1[C@@H]2CN(C(=O)[C@H](C(C)(C)C)NC(=O)O[C@@H]3C[C@H]3CCCCC(F)(F)c3nc4ccc(OC)cc4nc3O2)[C@@H]1C(=O)N[C@]1(C(=O)NS(=O)(=O)C2(C)CC2)C[C@H]1C(F)F] |

Degron Domain

In several aspects, described herein are synTF polypeptides comprising a degron domain. As used herein, the term "degron domain" refers to a sequence that promotes degradation of an attached protein, e.g., through the proteasome or autophagy-lysosome pathways; in some embodiments of any of the aspects, the terms "degron", "degradation domain" and "degradation domain" can be used interchangeably with "degron domain". In some embodiments, a degron domain is a polypeptide that destabilize a protein such that half-life of the protein is reduced at least two-fold, when fused to the protein. In some embodiments of any of the aspects, a synTF polypeptide as described herein (or a synTF polypeptide system collectively) comprises 1, 2, 3, 4, 5, or more degron domains. In some embodiments of any of the aspects, the synTF polypeptide or system comprises one degron domain. In embodiments comprising multiple degron domains, the multiple degron domains can be different individual degron domains or multiple copies of the same degron domain, or a combination of the foregoing.

Many different degron sequences/signals (e.g., of the ubiquitin-proteasome system) have been described, any of which can be used as provided herein. A degron domain may be operably linked to a cell receptor, but need not be contiguous or immediately adjacent with it as long as the degron domain still functions to direct degradation of the cell receptor. In some embodiments, the degron domain induces rapid degradation of the cell receptor. For a discussion of degron domains and their function in protein degradation, see, e.g., Kanemaki et al. (2013) Pflugers Arch. 465(3):419-425, Erales et al. (2014) Biochim Biophys Acta 1843(1):216-221, Schrader et al. (2009) Nat. Chem. Biol. 5(11): 815-822, Ravid et al. (2008) Nat. Rev. Mol. Cell. Biol. 9(9):679-690, Tasaki et al. (2007) Trends Biochem Sci. 32(11):520-528, Meinnel et al. (2006) Biol. Chem. 387(7): 839-851, Kim et al. (2013) Autophagy 9(7): 1100-1103, Varshaysky (2012) Methods Mol. Biol. 832: 1-11, and Fayadat et al. (2003) Mol Biol Cell. 14(3): 1268-1278; Chassin et al., Nature Communications volume 10, Article number: 2013 (2019); Natsume and Kanemaki Annu Rev Genet. 2017 Nov. 27,51:83-102; the contents of each of which is incorporated herein by reference in its entirety.

In some embodiments of any of the aspects, the degron domain comprises a ubiquitin tag, including but not limited to: UbR, UbP, UbW, UbH, UbI, UbK, UbQ, UbV, UbL, UbD, UbN, UbG, UbY, UbT, UbS, UbF, UbA, UbC, UbE, UbM, 3xUbVR, 3xUbVV, 2xUbVR, 2xUbVV, UbAR, UbVV, UbVR, UbAV, 2xUbAR, 2xUbAV. In some embodiments of any of the aspects, the degron domain comprises a self-excising degron, which refers to a complex comprising a repressible protease, a protease cleavage site, and a degron domain. In some embodiments of any of the aspects, the degron domain is a conditional degron domain, wherein the degradation is induced by ligands (e.g., a degron stabilizer) or another input such as temperature shift or a specific wave length of light. Non-limiting examples of conditional degron domains include the eDHFR degron (e.g., TMP inducer); FKBP12 (e.g., rapamycin analog inducer); temperature-sensitive dihydrofolate reductase (R-DHFRts, or ts-DHFR); an HCV NS3/NS4A degron; a modified version of R-DHFRts termed the low-temperature degron (lt-degron); auxin-inducible degradation (AID); HaloTag-Hydrophobic Tag, HaloPROTAC, and dTAG system (e.g., HyT13 or HyT36 inducer); photosensitive degron (PSD); blue-light-inducible degron (B-LID); tobacco etch virus (TEV) protease-induced protein inactivation (TIPI)-degron system; deGradFP (degrade green fluorescent protein; e.g., induced by NSlmb-vhhGFP expression); or split ubiquitin for the rescue of function (SURF; e.g., induced by rapamycin).

In some embodiments of any of the aspects, the degron domain is the *E. coli* dihydrofolate reductase (eDHFR) degron. The eDHFR degron permits extensive depletion of exogenously expressed proteins in mammalian cells and *C. elegans*. The eDHFR degron is stabilized by tight binding to the antibiotic and degron stabilizer trimethoprim (TMP), shown below, which is innocuous in eukaryotic cells.

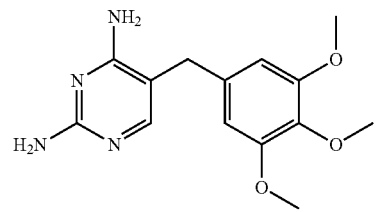 [SMILES: COc1cc(Cc2cnc(N)nc2N)cc(OC)c1OC]

Proteins tagged with eDHFR are constitutively degraded unless the cells are exposed to TMP. The level of tagged protein can be directly controlled by modulating the TMP concentration in the growth medium. Unlike shRNA methods this degron-based strategy is advantageous since depletion kinetics are not limited by the natural protein half-life, which allows for more rapid knockdown of stable proteins. TMP stabilizes the DD-target protein fusion in a dose-dependent manner up to 100-fold, which gives the system a substantial dynamic range. The ligand TMP works by itself and does not require dimerization with a second protein. This system is so effective that it can control the levels of transmembrane proteins, such as the synTF polypeptides described herein; see e.g., Schrader et al., Chem Biol. 2010 Sep. 24, 17(9): 917-918; Ryan M. Sheridan and David L. Bentley, Biotechniques. 2016, 60(2): 69-74; Iwamoto et al., Chem Biol. 2010 Sep. 24; 17(9):981-8.

In some embodiments of any of the aspects, the degron domain comprises an amino acid sequence derived from an FK506- and rapamycin-binding protein (FKBP12) (UniProtKB-P62942 (FKB1A_HUMAN), incorporated herein by reference), or a variant thereof. In some embodiments of any of the aspects, the FKBP12 derived amino acid sequence comprises a mutation of the phenylalanine (F) at amino acid position 36 (as counted without the methionine) to valine (V) (F36V) (also referred to as FKBP12* or FKBP*). In some embodiments of any of the aspects, the degron stabilizer is a rapamycin analog, such as Sheild-1, shown below. See e.g., Banaszynski et al., Cell. 2006 Sep. 8; 126(5): 995-1004; US Patent Application US20180179522; U.S. Pat. No. 10,137,180; the content of each of which is incorporated herein by reference in its entirety.

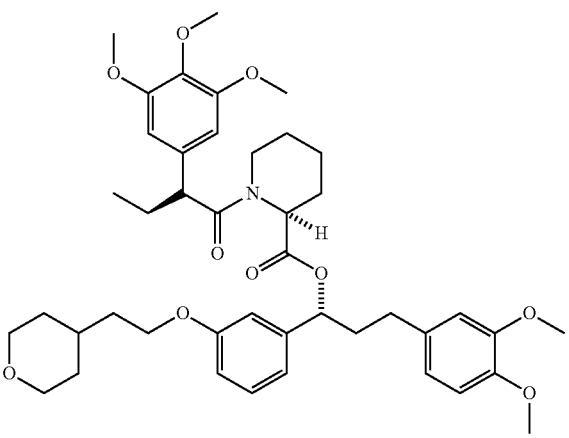

In some embodiments of any of the aspects, the degron domain of a synTF polypeptide as described herein comprises SEQ ID NOs: 317 or 318, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NOs: 317 or 318 that maintains the same function (e.g., degradation, binding to TMP or Shield-1).

```
SEQ ID NO: 317, DHFR (V19A), 158 aa,
ISLIAALAVDYVIGMENAMPWNLPADLAWFKRNTLNKPVIMGRHTWESIGRPLPGRKNIILSSQP

STDDRVTWVKSVDEAIAACGDVPEIMVIGGGRVIEQFLPKAQKLYLTHIDAEVEGDTHFPDYEPD

DWESVFSEFHDADAQNSHSYCFEILERR

SEQ ID NO: 318, FK506- and rapamycin-binding protein (FKBP), 107 aa
GVQVETISPGDGRTFPKRGQTCVVHYTGMLEDGKKFDSSRDRNKPFKFMLGKQEVIRGWEEGV

AQMSVGQRAKLTISPDYAYGATGHPGIIPPHATLVFDVELLKLE
```

In some embodiments of any of the aspects, the destabilizing degron domain comprises at least one mutation that causes almost complete removal or degradation of the synTF polypeptide. Non-limiting examples of DHFR (e.g., SEQ ID NO: 317) mutations include: V19A, Y100I, G121V, H12Y, H12L, R98H, F103S, M42T, H114R, I61F, T68S, H12Y/Y100I, H12L/Y100I, R98H/F103S, M42T/H114R, and I61F/T68S, or any combinations thereof; see e.g., U.S. Pat. No. 8,173,792, the content of which is incorporated herein by reference in its entirety.

In some embodiments of any of the aspects, the degron domain comprises a ligand-induced degradation (LID) domain. Proteins comprising a LID domain are destabilized and degraded in the presence of a degron destabilizer. In some embodiments of any of the aspects, the LID domain of a degron domain can bind to a degron destabilizer, promoting the degradation of the attached protein. The system is reversible and when the degron destabilizer is withdrawn, the protein is not destabilized and/or not degraded. In some embodiments of any of the aspects, a synTF polypeptide is bound to a degron destabilizer bound to the degron domain. In some embodiments of any of the aspects, the synTF polypeptide is bound specifically to a degron destabilizer bound to the degron domain.

In some embodiments of any of the aspects, the synTF polypeptide is in combination with 1, 2, 3, 4, 5, or more degron destabilizers. In some embodiments of any of the aspects, the synTF polypeptide is in combination with one degron destabilizer. In embodiments comprising multiple degron destabilizers, the multiple degron destabilizers can be different individual degron destabilizers or multiple copies of the same degron stabilizer, or a combination of the foregoing.

In some embodiments of any of the aspects, the LID degron domain comprises the FK506- and rapamycin-binding protein (FKBP), further comprising a degron fused to the C terminus of FKBP, e.g., with an intervening linker such as the 10-amino acid linker (Gly4SerGly4Ser) or another linker as described herein. In some embodiments of any of the aspects, the degron fused to the C terminus of FKBP (e.g., SEQ ID NO: 318) comprises the 19 amino acid sequence: TRGVEEVAEGVVLLRRRGN (SEQ ID NO: 319), or a sequence that is at least 95% identical that maintains the same function. In the absence of the small molecule Shield-1, the 19-aa degron is bound to the FKBP fusion protein, and the protein is stable. When present, Shield-1 binds tightly to FKBP, displacing the 19-aa degron and inducing rapid and processive degradation of the LID domain and any fused partner protein. In some embodiments of any of the aspects, the degron destabilizer is Sheild-1, shown above, or an analog thereof; see e.g., Bonger et al., Nat Chem Biol. 2011 Jul. 3; 7(8):531-7.

In some embodiments of any of the aspects, the degron domain comprises an auxin-inducible degradation (AID). Proteins fused to AID (also known as indole-3-acetic acid inducible 17 or AUX/IAA transcriptional regulator family protein) are rapidly degraded. Degradation requires the ectopic expression of the plant F-Box protein TIR1, which recruits proteins tagged with AID in an auxin-dependent manner to the SKP1-CULL-F-Box (SCF) ubiquitin E3 ligases resulting in their ubiquitylation and proteasomal degradation. In some embodiments of any of the aspects, the degron domain comprises residues 65-133, 65-130, 70-130, or 70-120 of SEQ ID NO: 320. In some embodiments of any of the aspects, the degron domain of a synTF polypeptide as described herein comprises SEQ ID NOs: 320 or 321, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NOs: 320 or 321 that maintains the same function. See e.g., Daniel et al., Nat Commun. 2018 Aug. 17; 9(1):3297; the content of which is incorporated herein by reference in its entirety.

```
AUX/IAA transcriptional regulator
family protein [Arabidopsis thaliana],
NCBI Reference Sequence: NP_171921.1, 229 aa
                                     SEQ ID NO: 320
MMGSVELNLRETELCLGLPGGDTVAPVTGNKRGFSETVDLKLNLNNEPA

NKEGSTTHDVVTFDSKEKSACPKDPAKPPAKAQVVGWPPVRSYRKNVMV

SCQKSSGGPEAAAFVKVSMDGAPYLRKIDLRMYKSYDELSNALSNMFSS

FTMGKHGGEEGMIDFMNERKLMDLVNSWDYVPSYEDKDGDWMLVGDVPW

PMFVDTCKRLRLMKGSDAIGLAPRAMEKCKSRA, mAID (minimal AID), 68 aa
                                     SEQ ID NO: 321
KEKSACPKDPAKPPAKAQVVGWPPVRSYRKNVMVSCQKSSGGPEAAAFV

KVSMDGAPYLRKIDLRMYK,
```

In some embodiments of any of the aspects, the degron domain comprises a modified portion of the NS3 helicase and NS4A. The arrangement of NS3pro and NS4A sequences in the construct creates a functional degron. During HCV replication, the free NS4A N-terminus forms a hydrophobic α-helix that is inserted into the endoplasmic reticulum membrane. This N-terminus is created by cleavage of the HCV nonstructural polypeptide at the NS3/4A junction due to its positioning in the protease active site by the NS3 helicase domain. The engineered construct lacks the helicase domain, so NS3/4A cleavage does not occur. The hydrophobic sequences of NS4A, unable to insert into the membrane without a free N-terminus, then exhibit degron-like activity. See e.g., U.S. Pat. No. 10,550,379; Chung et al., Nat Chem Biol. 2015 Sep.; 11(9): 713-720; the contents of which are incorporated herein by reference in their entireties.

In some embodiments of any of the aspects, the degron domain comprises SEQ ID NO: 322, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 322 that maintains the same function.

```
HCV NS3/NS4A degron domain (42 aa)
                                         SEQ ID NO: 322
PITKIDTKYIMTCMSADLEVVTSTWVLVGGVLAALAAYCLST,
```

Induced Degradation Domain

In several aspects, described herein are synTF polypeptides comprising an induced degradation domain, also referred to herein as a self-excising degron or a small molecule-assisted shutoff (SMASh) domain. In some embodiments of any of the aspects, the SMASh domain comprises a repressible protease, at least one protease cleavage site, and a degron domain. In the absence of the protease inhibitor, the repressible protease cleaves the degron from the synTF, and the synTF is not degraded. In the presence of the protease inhibitor, the repressible protease does not cleave the degron from the synTF, and the degron domain leads to the degradation of the synTF.

In some embodiments of any of the aspects, a synTF polypeptide as described herein (or a synTF polypeptide system collectively) comprises 1, 2, 3, 4, 5, or more induced degradation domain(s). In some embodiments of any of the aspects, the synTF polypeptide or system comprises one induced degradation domain. In embodiments comprising multiple induced degradation domains, the multiple induced degradation domains can be different individual induced degradation domains or multiple copies of the same induced degradation domain, or a combination of the foregoing.

In some embodiments of any of the aspects, degron domain (e.g., of the SMASh domain) is selected from the group consisting of: a ubiquitin tag; eDHFR degron (e.g., TMP inducer); FKBP12 (e.g., rapamycin analog inducer); temperature-sensitive dihydrofolate reductase (R-DHFRts, or ts-DHFR); an HCV NS3/NS4A degron; a modified version of R-DHFRts termed the low-temperature degron (lt-degron); auxin-inducible degradation (AID); HaloTag-Hydrophobic Tag, HaloPROTAC, and dTAG system (e.g., HyT13 or HyT36 inducer); photosensitive degron (PSD); blue-light-inducible degron (B-LID); tobacco etch virus (TEV) protease-induced protein inactivation (TIPI)-degron system; deGradFP (degrade green fluorescent protein; e.g., induced by NSlmb-vhhGFP expression); or split ubiquitin for the rescue of function (SURF; e.g., induced by rapamycin).

In some embodiments of any of the aspects, the degron domain (e.g., of the SMASh domain) comprises a modified portion of the NS3 helicase and NS4A. In some embodiments of any of the aspects, the degron domain (e.g., of the SMASh domain) comprises SEQ ID NO: 322, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 322 that maintains the same function.

In some embodiments of any of the aspects, the SMASh tag comprises a repressible protease, a partial protease helical domain, and a cofactor domain. In some embodiments of any of the aspects, the SMASh tag comprises a repressible protease, a partial protease helical domain, a cofactor domain, and at least one protease cleavage site. In some embodiments of any of the aspects, the SMASh tag comprises an NS3 repressible protease, an NS3 partial protease helical domain, an NS3 cofactor domain (i.e., NS4A), and at least one protease cleavage site of the NS3 repressible protease.

In some embodiments of any of the aspects, the SMASh tag is a C-terminal SMASh tag, e.g., the tag is engineered to be attached to the C-terminus of the synTF. In some embodiments of any of the aspects, the C-terminal SMASh tag comprises a protease cleavage site at the N-terminus of the tag. In some embodiments of any of the aspects, the C-terminal SMASh tag comprises in a N-terminal to C-terminal order: a NS3 cleavage site, at least one linker, a NS3 domain, a NS3 partial helicase, a NS4A domain. In some embodiments of any of the aspects, the C-terminal SMASh tag is fused to the C-terminus of the transcriptional effector domain of the synTF. In some embodiments of any of the aspects, the C-terminal SMASh tag is fused to the C-terminus of the DNA-binding domain of the synTF.

In some embodiments of any of the aspects, the C-terminal SMASh tag comprises SEQ ID NOs: 86, 324, 327, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 86, 324, 327 that maintains the same function.

```
SEQ ID NO: 86, C-terminal SMASh domain (304 aa); bold text indicates NS3 Cleavage
Site (SEQ ID NO: 87); italicized double underlined text indicates a Linker (SEQ ID NO: 88 or 90);
bold italicized text indicates the FLAG tag (SEQ ID NO: 89); italicized text indicates
the NS3 Protease Domain (SEQ ID NO: 91); unformatted text indicates NS3 Partial Helicase
(SEQ ID NO: 92); bold italicized double underlined text indicates NS4A Domain (SEQ ID NO: 93):
DEMEECSQHLPGAGSSGDIMDYKDDDDKGSSGTGSGSGTSAPITAYAQQTRGLLGCHTSLTGRDKN

QVEGEVQIVSTATQTFLATCINGVCWAVYHGAGTRTIASPKGPVIQMYTNVDQDLVGWPAPQGSRSLT

PCTCGSSDLYLVTRHADVIPVRRRGDSRGSLLSPRPISYLKGSSGGPLLCPAGHAVGLFRAAVCTRGVAK

AVDFIPVENLETTMRSPVFTDNSSPPAVTLTHPITKIDTKYIMTCMSADLEVVTSTWVLVGGVLAA

LAAYCLSTGCVVIVGRIVLSGKPAIIPDREVLY
```

In some embodiments of any of the aspects, the SMASh tag is a N-terminal SMASh tag, e.g., the tag is engineered to be attached to the N-terminus of the synTF. In some embodiments of any of the aspects, the N-terminal SMASh tag comprises a protease cleavage site at the C-terminus of the tag. In some embodiments of any of the aspects, the N-terminal SMASh tag comprises in a N-terminal to C-terminal order at least one Linker, a NS3 domain, a NS3 partial helicase, a NS4 domain, and a NS3 cleavage site. In some embodiments of any of the aspects, the N-terminal SMASh tag is fused to the N-terminus of the transcriptional effector domain of the synTF. In some embodiments of any of the aspects, the N-terminal SMASh tag is fused to the N-terminus of the DNA-binding domain of the synTF.

In some embodiments of any of the aspects, the N-terminal SMASh tag comprises SEQ ID NOs: 94, 95, 325, 326, 328, 329, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 94, 95, 325, 326, 328, or 329, that maintains the same function.

SEQ ID NO: 94, N-terminal SMASh domain (297 aa), *italicized double underlined text* indicates a Linker (SEQ ID NO: 88 or 90); bold italicized text indicates the FLAG tag (SEQ ID NO: 89); *italicized text* indicates the NS3 Protease Domain (SEQ ID NO: 91); unformatted text indicates NS3 Partial Helicase (SEQ ID NO: 92); *bold italicized double underlined text* indicates NS4A Domain (SEQ ID NO: 93); bold text indicates NS3 Cleavage Site (SEQ ID NO: 279):

*DYKDDDDKGSSGTGSGSGTS*APITAYAQQTRGLLGCIITSLTGRDKNQVEGEVQIVSTATQTFLATCING

VCWAVYHGAGTRTIASPKGPVIQMYTNVDQDLVGWPAPQGSRSLTPCTCGSSDLYLVTRHADVIPVRR

RGDSRGSLLSPRPISYLKGSSGGPLLCPAGHAVGLFRAAVCTRGVAKAVDFIPVENLETTMRSPVFTDN

SSPPAVTLTHPITKIDTKYIMTCMSADLEVVT*STWVLVGGVLAALAAYCLSTGCVVIVGRIVLSGK*

*PAIIPDREVLY*QEFEDVVPCSMGS

SEQ ID NO: 95, N-terminal SMASh domain (303 aa, with GSSGSS (SEQ ID NO: 323) L6 domain in NS4A), *italicized double underlined text* indicates a Linker; **bold *italicized* text** indicates the FLAG tag; *italicized text* indicates the NS3 Protease Domain; unformatted text indicates NS3 Partial Helicase; *bold italicized double underlined text* indicates NS4A Domain; bold text indicates NS3 Cleavage Site.

*DYKDDDDKGSSGTGSGSGTS*APITAYAQQTRGLLGCIITSLTGRDKNQVEGEVQIVSTATQTFLATCING

VCWAVYHGAGTRTIASPKGPVIQMYTNVDQDLVGWPAPQGSRSLTPCTCGSSDLYLVTRHADVIPVRR

RGDSRGSLLSPRPISYLKGSSGGPLLCPAGHAVGLFRAAVCTRGVAKAVDFIPVENLETTMRSPVFTDN

SSPPAVTLTHPITKIDTKYIMTCMSADLEVVT*STWVLVGGVLAALAAYCLSTGCVVIVGRIVLSGK*

*PAGSSGSSIIPDREVLY*QEFEDVVPCSMGS

In some embodiments of any of the aspects, SMASh domain comprises a repressible protease that comprises at least one mutation that increases its sensitivity to at least one protease inhibitor. In some embodiments of any of the aspects, the NS3 protease (e.g., of the SMASh domain) comprises at least one of the following mutations: V36M, T54A, S122G, F43L, Q80K, S122R, D168Y, or any combination thereof. In some embodiments of any of the aspects, the NS3 protease (e.g., of the SMASh domain) comprises at least one of the following mutations: V36M, T54A, S122G, or any combination thereof; such a SMASh is also referred to herein as SMASh$^{AI}$, as these mutations increase its sensitivity to asunaprevir (see e.g., SEQ ID NOs: 254, 324, 325, 326). In some embodiments of any of the aspects, the NS3 protease (e.g., of the SMASh domain) comprises at least one of the following mutations: F43L, Q80K, S122R, D168Y, or any combination thereof; such a protease is also referred to herein as SMASh$^{TT}$, as these mutations increase its sensitivity to telaprevir (see e.g., SEQ ID NOs: 255, 327, 328, 329).

SEQ ID NO: 324, C-terminal SMASh^(4I) domain with (304 aa); bold text indicates NS3 Cleavage Site; _italicized double underlined text_ indicates a Linker; _bold italicized text_ indicates the FLAG tag; _italicized text_ indicates the NS3 Protease Domain; unformatted text indicates NS3 Partial Helicase; _bold italicized double underlined text_ indicates NS4A Domain; the V36M, T54A, S122G mutations are shown in bold double underlined text, respectively.

DEMEECSQHL_PGAGSSGDIM__DYKDDDDK__GSSGTGSGSGTS_APITAYAQQTRGLLGCIITSLTGRDKN

QVEGEVQIMSTATQTFLATCINGVCWAVYHGAGTRTIASPKGPVIQMYTNVDQDLVGWPAPQGSRSLT

PCTCGSSDLYLVTRHADVIPVRRRGIGRGSLLSPRPISYLKGSSGGPLLCPAGHAVGLFRAAVCTRGVA

KAVDFIPVENLETTMRSPVFTDNSSPPAVTLTHPITKIDTKYIMTCMSADLEVVT_STWVLVGGVLA_

_ALAAYCLSTGCVVIVGRIVLSGKPAIIPDREVLY_

SEQ ID NO: 325, N-terminal SMASh^(4I) domain (297 aa), _italicized double underlined text_ indicates a Linker; _bold italicized text_ indicates the FLAG tag; _italicized text_ indicates the NS3 Protease Domain; unformatted text indicates NS3 Partial Helicase; indicates _bold italicized double underlined text_ indicates NS4A Domain; bold text indicates NS3 Cleavage Site; the V36M, T54A, 5122G mutations are shown in bold double underlined text, respectively.

_DYKDDDDK__GSSGTGSGSGTS_APITAYAQQTRGLLGCIITSLTGRDKNQVEGEVQIMSTATQTFLATCIN

GVCWAVYHGAGTRTIASPKGPVIQMYTNVDQDLVGWPAPQGSRSLTPCTCGSSDLYLVTRHADVIPVR

RRGIGRGSLLSPRPISYLKGSSGGPLLCPAGHAVGLFRAAVCTRGVAKAVDFIPVENLETTMRSPVFTD

NSSPPAVTLTHPITKIDTKYIMTCMSADLEVVT_STWVLVGGVLAALAAYCLSTGCVVIVGRIVLSG_

_KPAIIPDREVLY_QEFEDVVPCSMGS

SEQ ID NO: 326, N-terminal SMASh^(4I) domain (303 aa, with L6 domain in NS4A), _italicized double underlined text_ indicates a Linker; _bold italicized text_ indicates the FLAG tag; _italicized text_ indicates the NS3 Protease Domain; unformatted text indicates NS3 Partial Helicase; _bold italicized double underlined text_ indicates NS4A Domain; bold text indicates NS3 Cleavage Site; the V36M, T54A, 5122G mutations are shown in bold double underlined text, respectively.

_DYKDDDDK__GSSGTGSGSGTS_APITAYAQQTRGLLGCHTSLTGRDKNQVEGEVQIMSTATQTFLATCIN

GVCWAVYHGAGTRTIASPKGPVIQMYTNVDQDLVGWPAPQGSRSLTPCTCGSSDLYLVTRHADVIPVR

RRGIGRGSLLSPRPISYLKGSSGGPLLCPAGHAVGLFRAAVCTRGVAKAVDFIPVENLETTMRSPVFTD

NSSPPAVTLTHPITKIDTKYIMTCMSADLEVVT_STWVLVGGVLAALAAYCLSTGCVVIVGRIVLSG_

_KPAGSSGSSIIPDREVLY_QEFEDVVPCSMGS

SEQ ID NO: 327, C-terminal SMASh^(TI) domain with (304 aa); bold text indicates NS3 Cleavage Site; _italicized double underlined text_ indicates a Linker; _bold italicized text_ indicates the FLAG tag; _italicized text_ indicates the NS3 Protease Domain; unformatted text indicates N53 Partial Helicase; _bold italicized double underlined text_ indicates NS4A Domain; the F43L, Q80K, S122R, D168Y mutations are shown in bold double underlined text, respectively.

DEMEECSQHL_PGAGSSGDIM__DYKDDDDK__GSSGTGSGSGTS_APITAYAQQTRGLLGCHTSLTGRDKN

QVEGEVQIVSTATQTLLATCINGVCWAVYHGAGTRTIASPKGPVIQMYTNVIKDLVGWPAPQGSRSLT

PCTCGSSDLYLVTRHADVIPVRRRGIRRGSLLSPRPISYLKGSSGGPLLCPAGHAVGLFRAAVCTRGVA

KAVYFIPVENLETTMRSPVFTDNSSPPAVTLTHPITKIDTKYIMTCMSADLEVVT_STWVLVGGVLA_

_ALAAYCLSTGCVVIVGRIVLSGKPAIIPDREVLY_

SEQ ID NO: 328, N-terminal SMASh^(TI) domain (297 aa), _italicized double underlined text_ indicates a Linker; _bold italicized text_ indicates the FLAG tag; _italicized text_ indicates the NS3 Protease Domain; unformatted text indicates NS3 Partial Helicase; _bold italicized double underlined text_ indicates NS4A Domain; bold text indicates NS3 Cleavage Site; the F43L, Q80K, 5122R, D168Y mutations are shown in bold double underlined text, respectively.

_DYKDDDDK__GSSGTGSGSGTS_APITAYAQQTRGLLGCHTSLTGRDKNQVEGEVQIVSTATQTLLATCING

VCWAVYHGAGTRTIASPKGPVIQMYTNVIKDLVGWPAPQGSRSLTPCTCGSSDLYLVTRHADVIPVRR

RGIRRGSLLSPRPISYLKGSSGGPLLCPAGHAVGLFRAAVCTRGVAKAVYFIPVENLETTMRSPVFTDN

SSPPAVTLTHPITKIDTKYIMTCMSADLEVVT_STWVLVGGVLAALAAYCLSTGCVVIVGRIVLSGK_

_PAIIPDREVLY_QEFEDVVPCSMGS

-continued

SEQ ID NO: 329, N-terminal SMASh<sup>TT</sup> domain (303 aa, with L6 domain in NS4A),
<u>*italicized double underlined text*</u> indicates a Linker; _bold italicized text_
indicates the FLAG tag; *italicized text* indicates the NS3 Protease Domain;
unformatted text indicates NS3 Partial Helicase; _bold italicized_ <u>double</u>
<u>underlined text</u> indicates NS4A Domain; bold text indicates NS3 Cleavage Site;
the F43L, Q80K, 5122R, D168Y mutations are shown in
bold <u>double underlined text</u>, respectively.

_DYKDDDDK_<u>*GSSGTGSGSGTS*</u>*APITAYAQQTRGLLGCHTSLTGRDKNQVEGEVQIVSTATQTLLATCING*

*VCWAVYHGAGTRTIASPKGPVIQMYTNVIKDLVGWPAPQGSRSLTPCTGSSDLYLVTRHADVIPVRR*

*RGDFRGSLLSPRPISYLKGSSGGPLLCPAGHAVGLFRAAVCTRGVAKAVYFIPVENLETTMRSPVFTDN*

SSPPAVTLTHPITKIDTKYIMTCMSADLEVVT<u>_STWVLVGGVLAALAAYCLSTGCVVIVGRIVLSGK_</u>

<u>_PAGSSGSSIIPDREVLY_</u>QEFEDVVPCSMGS

In some embodiments of any of the aspects, the SMASh domain of the synTF polypeptide is in combination with 1, 2, 3, 4, 5, or more protease inhibitors. In some embodiments of any of the aspects, the SMASh domain of the synTF polypeptide is in combination with one protease inhibitor. In embodiments comprising multiple protease inhibitors, the multiple protease inhibitors can be different individual protease inhibitors or multiple copies of the same protease inhibitor, or a combination of the foregoing.

In some embodiments of any of the aspects, the protease inhibitor is grazoprevir (abbreviated as GZV or GZP; see e.g., PubChem CID: 44603531). In some embodiments of any of the aspects, the protease inhibitor is danoprevir (DNV; see e.g., PubChem CID: 11285588). In some embodiments of any of the aspects, the protease inhibitor is an approved NS3 protease inhibitor, such as but not limited to grazoprevir, danoprevir, simeprevir, asunaprevir, ciluprevir, boceprevir, sovaprevir, paritaprevir, ombitasvir, paritaprevir, ritonavir, dasabuvir, and telaprevir. Additional non-limiting examples of NS3 protease inhibitors are listed in Table 16 (see e.g., McCauley and Rudd, Hepatitis C virus NS3/4a protease inhibitors, Current Opinion in Pharmacology 2016, 30:84-92; the content of which is incorporated herein by reference in its entirety).

Induced Proximity Domains

In several aspects, described herein are synTF polypeptides comprising at least two induced proximity domains, also referred to herein as heterodimerization domains. As used herein the term "induced proximity domains" refers to at least two domains that are induced to dimerize or come into close proximity in the presence of a stimulus (e.g., chemical inducer, light, etc.). In some embodiments of any of the aspects, the induced proximity domain pair comprises a first induced proximity domain (IPD$^A$) and at least a second induced proximity domain (IPD$^B$), wherein in the presence of an inducer agent or inducer signal, the IPD$^A$ and IPD$^B$ come together. In some embodiments of any of the aspects, the synTF effector domain is linked to IPD$^A$ (or IPD$^B$) in a first polypeptide, and the synTF DBD is linked to IPD$^B$ (or IPD$^A$) in a second polypeptide. Thus, in the presence of an inducer agent or inducer signal, the IPD$^A$ and IPD$^B$ come together linked to resulting in the linkage of the ED to the DBD of the synthetic TF. In the absence of an inducer agent or inducer signal, the ED is uncoupled or unlinked to the DBD of the synthetic TF.

In some embodiments of any of the aspects, a synTF polypeptide as described herein (or a synTF polypeptide system collectively) comprises 1, 2, 3, 4, 5, or more induced proximity domain(s). In some embodiments of any of the aspects, the synTF polypeptide or system comprises one induced proximity domain. In embodiments comprising multiple induced proximity domains, the multiple induced proximity domains can be different individual induced proximity domains or multiple copies of the same induced proximity domain, or a combination of the foregoing.

In some embodiments of any of the aspects, the induced proximity domain pair (IPD pair) comprises a IPD$^A$ and IPD$^B$ selected from any one or more of: (1) a IPD$^A$ comprising a GID1 domain or a fragment thereof, and a IPD$^B$ comprising a GAI domain, wherein the GID1 domain and GAI domain bind to the inducer agent Gibberellin Ester (GIB); (2) a IPD$^A$ comprising a FKBP domain or a fragment thereof, and a IPD$^B$ comprising a FRB domain, wherein the FKBP domain and FRB domain bind to the inducer agent Rapalog (RAP); (3) a IPD$^A$ comprising a PYL domain or a fragment thereof, and a IPD$^B$ comprising a ABI domain, wherein the PYL domain and ABI domain bind to the inducer agent Abscisic acid (ABA); (4) a IPD$^A$ comprising a Light-inducible dimerization domain (LIDD), wherein a LIDD dimerizes with a complementary LIDD (IPD$^B$) upon exposure to a light inducer signal of an appropriate wavelength.

In some embodiments of any of the aspects, the synTF polypeptide is in combination with 1, 2, 3, 4, 5, or more inducer agents, i.e., that induce dimerization or proximity of the IPDs. In some embodiments of any of the aspects, the synTF polypeptides are in combination with one inducer agent. In embodiments comprising multiple inducer agents, the multiple inducer agents can be different individual inducer agents or multiple copies of the same inducer agent, or a combination of the foregoing.

In some embodiments of any of the aspects, the IPD pair comprises a ABI (ABA insensitive) domain and a PYL (pyrabactin resistance-like) domain, derived from components of the Abscisic acid (ABA) signaling pathway from *Arabidopsis thaliana*. In some embodiments of any of the aspects, the IPD pair comprises the interacting complementary surfaces (CSs) of PYL1 (PYLcs, amino acids 33 to 209) and ABI1 (ABIcs, amino acids 126 to 423). In some embodiments of any of the aspects, the ABI domain (e.g., SEQ ID NO: 66) comprises mutations A18D and E108G. In some embodiments of any of the aspects, the ABI domain further comprises a detectable marker (e.g., a FLAG tag). In some embodiments of any of the aspects, the PYL domain further comprises a detectable marker (e.g., an HA tag).

In some embodiments of any of the aspects, the ABI domain comprises SEQ ID NOs: 66 or 107 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 66 or 107, that maintains the same function.

In some embodiments of any of the aspects, the PYL domain comprises SEQ ID NOs: 71 or 108 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 71 or 108, that maintains the same function.

SEQ ID NO: 66, ABI cs CO1 (298 aa)
VPLYGFTSICGRRPEMEAAVSTIPRFLQSSSGSMLDGRFDPQSAAHFFGV

YDGHGGSQVANYCRERMHLALAEEIAKEKPMLCDGDTWLEKWKKALFNSF

LRVDSEIESVAPETVGSTSVVAVVFPSHIFVANCGDSRAVLCRGKTALPL

SVDHKPDREDEAARIEAAGGKVIQWNGARVFGVLAMSRSIGDRYLKPSII

PDPEVTAVKRVKEDDCLILASDGVWDVMTDEEACEMARKRILLWHKKNAV

AGDASLLADERRKEGKDPAAMSAAEYLSKLAIQRGSKDNISVVVVDLK

SEQ ID NO: 71, PYL1cs Domain (177 aa)
TQDEFTQLSQSIAEFHTYQLGNGRCSSLLAQRIHAPPETVWSVVRRFDRP

QIYKHFIKSCNVSEDFEMRVGCTRDVNVISGLPANTSRERLDLLDDDRRV

TGFSITGGEHRLRNYKSVTTVHRFEKEEEEERIWTVVLESYVVDVPEGNS

EEDTRLFADTVIRLNLQKLASITEAMN

SEQ ID NO: 107, Alternative ABI binding motif
PLYGFTSICGRRPEMEDAVSTIPRFLQSSSGSMLDGRFDPQSAAHFFGVY

DGHGGSQVANYCRERMHLALAEEIAKEKPMLCDGDTWLEKWKKALFNSFL

RVDSEIGSVAPETVGSTSVVAVVFPSHIFVANCGDSRAVLCRGKTALPLS

VDHKPDREDEAARIEAAGGKVIQWNGARVFGVLAMSRSIGDRYLKPSIIP

DPEVTAVKRVKEDDCLILASDGVWDVMTDEEACEMARKRILLWHKKNAVA

GDASLLADERRKEGKDPAAMSAAEYLSKLAIQRGSKDNISVVVVDLKDYK

DDDDK

SEQ ID NO: 108, Alternative PYL binding motif
APTQDEFTQLSQSIAEFHTYQLGNGRCSSLLAQRIHAPPETVWSVVRRFD

RPQIYKHFIKSCNVSEDFEMRVGCTRDVNVISGLPANTSRERLDLLDDDR

RVTGFSITGGEHRLRNYKSVTTVHRFEKEEEEERIWTVVLESYVVDVPEG

NSEEDTRLFADTVIRLNLQKLASITEAMNYPYDVPDYA

In some embodiments of any of the aspects, the proximity inducer agent (e.g., for ABI and PYL domains) is abscisic acid (ABA):

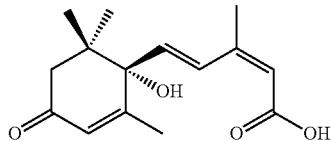

In some embodiments, the IPD pair are FKBP (FK506- and rapamycin-binding protein) and FKBP12-rapamycin-binding protein (FRB) proteins, which come together and dimerize in the presence of a rapalog. In some embodiments of any of the aspects, the FKBP domain comprises SEQ ID NOs: 109 or 318 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 109 or 318, that maintains the same function. In some embodiments of any of the aspects, the FRB domain comprises SEQ ID NO: 110 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 110, that maintains the same function.

SEQ ID NO: 109, FKBP aa binding motif:
SRGVQVETISPGDGRTFPKRGQTCVVHYTGMLEDGKKFDSSRDRNKPFK
FMLGKQEVIRGWEEGVAQMSVGQRAKLTISPDYAYGATGHPGIIPPHAT
LVFDVELLKLE SEQ ID NO: 110, FRB binding motif,
ILWHEMWHEGLEEASRLYFGERNVKGMFEVLEPLHAMMERGPQTLKETS
FNQAYGRDLMEAQEWCRKYMKSGNVKDLLQAWDLYYHVFRRIS In some embodiments of any of the aspects, the proximity inducer agent (e.g., for FKBP and FRB domains) is rapamycin shown below. In some embodiments of any of the aspects, the proximity inducer agent (e.g., for FKBP and FRB domains) is a rapalog, i.e., a rapamycin analog. In some embodiments of any of the aspects, the rapalog is Sheild-1, as described further herein.

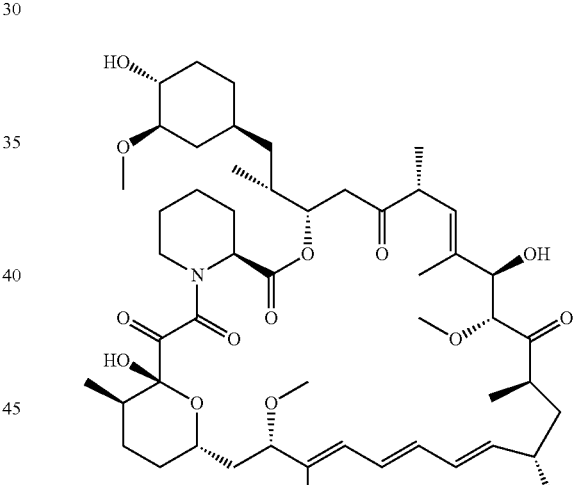

In other embodiments, the IPD pair are GAI (Gibberellin insensitive) and GID1 (Gibberellin insensitive dwarf1) proteins, derived from, Arabidopsis thaliana, which come together in the presence of Gibberellin Ester (GE). In some embodiments of any of the aspects, the GAI domain comprises SEQ ID NO: 111 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 111, that maintains the same function. In some embodiments of any of the aspects, the GAI domain comprises the amino-terminal DELLA domain of GAI. In some embodiments of any of the aspects, the GID domain comprises SEQ ID NO: 112 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 112, that maintains the same function.

```
SEQ ID NO: 111, GAI binding motif,
MKRDHHHHHHQDKKTMMMNEEDDGNGMDELLAVLGYKVRSSEMADVAQKL
EQLEVMMSNVQEDDLSQLATETVHYNPAELYTWLDSMLTDLN SEQ ID NO: 112, GID1 binding motif
MAASDEVNLIESRTVVPLNTWVLISNFKVAYNILRRPDGTFNRHLAEYLD

RKVTANANPVDGVFSFDVLIDRRINLLSRVYRPAYADQEQPPSILDLEKP

VDGDIVPVILFFHGGSFAHSSANSAIYDTLCRRLVGLCKCVVVSVNYRRA

PENPYPCAYDDGWIALNWVNSRSWLKSKKDSKVHIFLAGDSSGGNIAHNV

ALRAGESGIDVLGNILLNPMFGGNERTESEKSLDGKYFVTVRDRDWYWKA

FLPEGEDREHPACNPFSPRGKSLEGVSFPKSLVVVAGLDLIRDWQLAYAE

GLKKAGQEVKLMHLEKATVGFYLLPNNNHFHNVMDEISAFVNAEC
```

In some embodiments of any of the aspects, the proximity inducer agent (e.g., for GAI and GID1 domains) is a bioactive gibberellin (shown below), a Gibberellin Ester (GE), or another gibberellin analog.

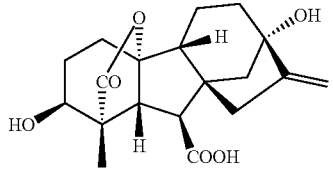

In some embodiments, the IPD pair comprises a caffeine-induced dimerization system, such as a VHH camelid antibody (referred to as aCaffVHH) that has high affinity (Kd=500 nM) and homodimerizes in the presence of caffeine. In some embodiments, the IPD pair is selected from a combinatorial binders-enabled selection of chemically induced dimerization systems (COMBINES-CID), using a specific chemical ligand. As a non-limiting example, the ligand can be CBD (cannabidiol). In some embodiments, the IPD pair comprises human antibody-based chemically induced dimerizes (AbCIDs), which are derived from known small-molecule-protein complexes by selecting for synthetic antibodies that recognize the chemical epitope created by the small molecule bound to the protein (e.g., ABT-737). In some embodiments, the IPD pair comprises Calcineurin and FKBP, which come together in the presence of FK506. In some embodiments, the IPD pair comprises Calcineurin and prolyl isomerase CyP, which come together in the presence of Cyclosporine A. In some embodiments, the IPD pair comprises CyP and FKBP, which come together in the presence of FKCsA, a fusion of FK506 and Cyclosprin A. In some embodiments, the IPD pair comprises two copies of FKBP, which come together in the presence of FK2012, a fusion of two FK506 molecules. See e.g., Franco et al., Journal of Chromatography B, Volume 878, Issue 2, 15 Jan. 2010, Pages 177-186; Liang et al. Sci Signal 2011 Mar. 15; 4(164):rs2; Laura A. Banaszynski et al. JACS 2005 Apr. 6; 127(13):4715-21; Miyamoto et al. Nat Chem Biol Nature Chemical Biology volume 8, pages465-470(2012); Bojar et al. Nature Communications volume 9, Article number: 2318 (2018); Kang et al. JACS 2019 Jul. 17; 141(28): 10948-10952; Hill et al. Nat ChemBio 2018 February; 14(2):112-117; Stanton et al. Science 2018 Mar. 9; 359(6380): eaao5902; Weinberg et al. Nat Biotech 2017 May; 35(5): 453-462; Matthew J Kennedy, Nature Methods volume 7, pages 973-975(2010); US Patent Applications US20180163195 and US20170183654; U.S. Pat. No. 8,735, 096; the contents of each of which are incorporated herein by reference in their entireties.

In some embodiments, the IPD pair comprises a light-inducible dimerization domain (LIDD) pair, non-limiting examples of which include nMag/nMag, CRY2/CIBN, and photochromic proteins. In some embodiments, the IPD pair comprises a light-inducible dimerization domain (LIDD) pair, such as nMag and pMag proteins, which come together and dimerize in a blue light signal, e.g., after a blue light pulse signal, or pulse of a light of an appropriate wavelength. In some embodiments of any of the aspects, the nMag domain comprises SEQ ID NO: 113 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 113, that maintains the same function. In some embodiments of any of the aspects, the pMag domain comprises SEQ ID NO: 114 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 114, that maintains the same function.

```
SEQ ID NO: 113, nMag binding motif
HTLYAPGGYDIMGYLDQIGNRPNPQVELGPVDTSCALILCDLKQKDTPIV
YASEAFLYMTGYSNAEVLGRNCRFLQSPDGMVKPKSTRKYVDSNTINTMR
KAIDRNAEVQVEVVNFKKNGQRFVNFLTMIPVRDETGEYRYSMGFQCETE SEQ ID NO: 114, pMag binding motif
HTLYAPGGYDIMGYLRQIRNRPNPQVELGPVDTSCALILCDLKQKDTPIV
YASEAFLYMTGYSNAEVLGRNCRFLQSPDGMVKPKSTRKYVDSNTINTMR
KAIDRNAEVQVEVVNFKKNGQRFVNFLTMIPVRDETGEYRYSMGFQCETE
```

In some embodiments, the IPD pair comprises a light-inducible dimerization domain (LIDD) pair, such as cryptochrome 2 (CRY2) and CIBN (a truncated version of CIB1 (CRY2 interacting basic-helix-loop-helix 1)) and proteins, derived from Arabidopsis thaliana, which come together and dimerize in a blue light signal, e.g., after a blue light pulse signal, or pulse of a light of an appropriate wavelength. In some embodiments of any of the aspects, the CIBN domain comprises SEQ ID NO: 115 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 115, that maintains the same function. In some embodiments of any of the aspects, the CRY2 domain comprises SEQ ID NO: 116 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 116, that maintains the same function.

```
SEQ ID NO: 115, CIBN LIDD
MNGAIGGDLLLNFPDMSVLERQRAHLKYLNPTFDSPLAGFFADSSMITG

GEMDSYLSTAGLNLPMMYGETTVEGDSRLSISPETTLGTGNFKKRKFDT
```

-continued

ETKDCNEKKKKMTMNRDDLVEEGEEEKSKITEQNNGSTKSIKKMKHKAK

KEENNFSNDSSKVTKELEKTDYIH

SEQ ID NO: 116, CRY2 LIDD
MKMDKKTIVWFRRDLRIEDNPALAAAAHEGSVFPVFIWCPEEEGQFYPGR

ASRWWMKQSLAHLSQSLKALGSDLTLIKTHNTISAILDCIRVTGATKVVF

NHLYDPVSLVRDHTVKEKLVERGISVQSYNGDLLYEPWEIYCEKGKPFTS

FNSYWKKCLDMSIESVMLPPPWRLMPITAAAEAIWACSIEELGLENEAEK

PSNALLTRAWSPGWSNADKLLNEFIEKQLIDYAKNSKKVVGNSTSLLSPY

LHFGEISVRHVFQCARMKQIIWARDKNSEGEESADLFLRGIGLREYSRYI

CFNFPFTHEQSLLSHLRFFPWDADVDKFKAWRQGRTGYPLVDAGMRELWA

TGWMHNRIRVIVSSFAVKFLLLPWKWGMKYFWDTLLDADLECDILGWQYI

SGSIPDGHELDRLDNPALQGAKYDPEGEYIRQWLPELARLPTEWIHHPWD

APLTVLKASGVELGTNYAKPIVDIDTARELLAKAISRTREAQIMIGAAPD

EIVADSFEALGANTIKEPGLCPSVSSNDQQVPSAVRYNGSKRVKPEEEEE

RDMKKSRGFDERELFSTAESSSSSSVFFVSQSCSLASEGKNLEGIQDSSD

QITTSLGKNGCK

In some embodiments, the IPD pair comprises a light-inducible dimerization domain (LIDD) pair, such as photochromic protein domains including, but not limited to Dronpa, Padron, rsTagRFP, and mApple, or a variant or polypeptide fragment thereof having fluorescence characteristics (e.g., Dronpa-145N, Padron-145N, or mApple-162H-164A). Such photochromic protein domains dimerize in the presence of a specific wavelength (e.g., blue light). In some embodiments of any of the aspects, the photochromic protein domain comprises one of SEQ ID NOs: 330-333 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 330-333, that maintains the same function.

SEQ ID NO: 330, Dropna-145K (224 aa)
MSVIKPDMKIKLRMEGAVNGHPFAIEGVGLGKPFEGKQSMDLKVKEGGPL

PFAYDILTTVFCYGNRVFAKYPENIVDYFKQSFPEGYSWERSMNYEDGGI

CNATNDITLDGDCYIYEIRFDGVNFPANGPVMQKRTVKWEPSTEKLYVRD

GVLKGDVNMALSLEGGGHYRCDFKTTYKAKKVVQLPDYHFVDHHIEIKSH

DKDYSNVNLHEHAEAHSELPRQAK

SEQ ID NO: 331, Dropna-145N (224 aa)
MSVIKPDMKIKLRMEGAVNGHPFAIEGVGLGKPFEGKQSMDLKVKEGGPL

PFAYDILTTVFCYGNRVFAKYPENIVDYFKQSFPEGYSWERSMNYEDGGI

CNATNDITLDGDCYIYEIRFDGVNFPANGPVMQKRTVKWEPSTENLYVRD

GVLKGDVNMALSLEGGGHYRCDFKTTYKAKKVVQLPDYHFVDHHIEIKSH

DKDYSNVNLHEHAEAHSELPRQAK

SEQ ID NO: 332, Padron-145N (224 aa)
MSVIKPDMKIKLRMEGAVNGHPFAIEGVGLGKPFEGKQSMDLKVKEGGPL

PFAYDILTMAFCYGNRVFAKYPENIVDYFKQSFPEGYSWERSMHYEDGGS

CNATNDITLDGDCYIYEIRFDGVNFPANGPVMQKRTVKWERSTENLYVRD

GVLKSDGNYALSLEGGGHYRCDFKTTYKAKKVVQLPDYHSVDHHIEIKSH

DKDYSNVNLHEHAEAHSELPRQAN

SEQ ID NO: 333, mApple-162H-164A (236 aa)
MVSKGEENNMAIIKEFMRFKVHMEGSVNGHEFEIEGEGEGRPYEAFQTAK

LKVTKGGPLPFAWDILSPQFMYGSKVYIKHPADIPDYFKLSFPEGFRWER

VMNFEDGGIIHVNQDSSLQDGVFIYKVKLRGTNFPSDGPVMQKKTMGWEA

SEERMYPEDGAHKAEIKKRLKLKDGGHYAAEVKTTYKAKKPVQLPGAYIV

DIKLDIVSHNEDYTIVEQYERAEGRHSTGGMDELYK

Cytosolic Sequestering Domain

In several aspects, described herein are synTF polypeptides comprising a cytosolic sequestering domain or protein, also referred to herein as a translocation domain. As used herein, the term "cytosolic sequestering domain" refers to a domain that influences the subcellular location of the synTF to which it is linked, e.g., through the binding of a ligand.

In some embodiments of any of the aspects, a synTF polypeptide as described herein (or a synTF polypeptide system collectively) comprises 1, 2, 3, 4, 5, or more cytosolic sequestering domain(s). In some embodiments of any of the aspects, the synTF polypeptide or system comprises one cytosolic sequestering domain. In embodiments comprising multiple cytosolic sequestering domains, the multiple cytosolic sequestering domains can be different individual cytosolic sequestering domains or multiple copies of the same cytosolic sequestering domain, or a combination of the foregoing.

In some embodiments of any of the aspects, the cytosolic sequestering protein comprises a ligand binding domain (LBD), wherein in the presence of the ligand, the sequestering of the protein to the cytosol is inhibited. In some embodiments of any of the aspects, cytosolic sequestering protein further comprises a nuclear localization signal (NLS), wherein in the absence of the ligand the NLS is inhibited thereby preventing translocation of the sequestering protein to the nucleus, and wherein in the presence of the ligand the nuclear localization signal is exposed enabling translocation of the sequestering protein to the nucleus. Accordingly, when the ligand is absent, the synTF is sequestered to the cytosol. When the ligand is absent, the synTF is translocated to the nucleus.

In some embodiments of any of the aspects, the sequestering protein comprises at least a portion of the estrogen receptor (ER). The ER naturally associates with cytoplasmic factors in the cell in the absence of cognate ligands, effectively sequestering itself in the cytoplasm. Binding of cognate ligands, such as estrogen or other steroid hormone derivatives, cause a conformational change to the receptor that allow dissociation from the cytoplasmic complexes and expose a nuclear localization signal, permitting translocation into the nucleus.

In some embodiments of any of the aspects, the sequestering protein comprises SEQ ID NO: 334 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 334 that maintains the same function. In some embodiments of any of the aspects, the sequestering protein comprises a portion of the ER (e.g., SEQ ID NO: 334), e.g., the C-terminal ligand-binding and nuclear localization domains of ER. In some embodiments of any of the aspects, the sequestering protein comprises residues 282-595 of SEQ ID NO: 334 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to residues 282-595 of SEQ ID NO: 334.

```
SEQ ID NO: 334, estrogen receptor isoform 1 [Homo
sapiens]; NCBI Reference Sequence: NP_000116.2
(595 aa)
MTMTLHTKASGMALLHQIQGNELEPLNRPQLKIPLERPLGEVYLDSSKPA

VYNYPEGAAYEFNAAAAANAQVYGQTGLPYGPGSEAAAFGSNGLGGFPPL

NSVSPSPLMLLHPPPQLSPFLQPHGQQVPYYLENEPSGYTVREAGPPAFY

RPNSDNRRQGGRERLASTNDKGSMAMESAKETRYCAVCNDYASGYHYGVW

SCEGCKAFFKRSIQGHNDYMCPATNQCTIDKNRRKSCQACRLRKCYEVGM

MKGGIRKDRRGGRMLKHKRQRDDGEGRGEVGSAGDMRAANLWPSPLMIKR

SKKNSLALSLTADQMVSALLDAEPPILYSEYDPTRPFSEASMMGLLTNLA

DRELVHMMWAKRVPGFVDLTLHDQVHLLECAWLEILMIGLVWRSMEHPGK

LLFAPNLLLDRNQGKCVEGMVEIFDMLLATSSRFRMMNLQGEEFVCLKSI

ILLNSGVYTFLSSTLKSLEEKDHIHRVLDKITDTLIHLMAKAGLTLQQQH
```

-continued
```
QRLAQLLLILSHIRHMSNKGMEHLYSMKCKNVVPLYDLLLEMLDAHRLHA

PTSRGGASVEETDQSHLATAGSTSSHSLQKYYITGEAEGFPATV
```

In some embodiments of any of the aspects, the estrogen receptor comprises at least one mutation that decreases its ability to bind to its natural ligands (e.g., estradiol) but maintains the ability to bind to synthetic ligands such as tamoxifen and analogs thereof. In some embodiments of any of the aspects, the estrogen receptor comprises at least one of the following mutations: G400V, G521R, L539A, L540A, M543A, L544A, V595A or any combination thereof. In some embodiments of any of the aspects, a triple G400V/MS43A/L544A ER mutant is referred to herein as ERT2. In some embodiments of any of the aspects, the sequestering protein further comprises a V595A mutation from ER (e.g., SEQ ID NO: 334). In some embodiments of any of the aspects, the sequestering protein comprises an estrogen ligand binding domain (ERT2) or a variant thereof. In some embodiments of any of the aspects, the sequestering protein comprises ERT, ERT2, ERT3, or a variant thereof. In some embodiments of any of the aspects, the sequestering protein comprises one of SEQ ID NOs: 74, 335-337 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 74, 335-337, that maintains the same function. See e.g., U.S. Pat. No. 7,112,715; Feil et al., Biochemical and Biophysical Research Communications, Volume 237, Issue 3, 28 Aug. 1997, Pages 752-757; Felker et al., PLoS One. 2016 Apr. 14; 11(4):e0152989; the contents of each of which are incorporated herein by reference in their enteritis.

```
SEQ ID NO: 74, ERT2 (314 aa), G400V, M543A, L544A, and V595A mutations
from ER (e.g., SEQ ID NO: 334) shown in bold, double underlined text
SAGDMRAANLWPSPLMIKRSKKNSLALSLTADQMVSALLDAEPPILYSEYDPTRPFSEASMMGL

LTNLADRELVHMMWAKRVPGFVDLTLHDQVHLLECAWLEILMIGLVWRSMEHPVKLLFAPNL

LLDRNQGKCVEGMVEIFDMLLATSSRFRMMNLQGEEFVCLKSIILLNSGVYTFLSSTLKSLEEKD

HIHRVLDKITDTLIHLMAKAGLTLQQQHQRLAQLLLILSHIRHMSNKGMEHLYSMKCKNVVPLY

DLLLEAADAHRLHAPTSRGGASVEETDQSHLATAGSTSSHSLQKYYITGEAEGFPATA

SEQ ID NO: 335, ERT (314 aa), G521R mutation from ER
(e.g., SEQ ID NO: 334) shown in bold, double underlined text
SAGDMRAANLWPSPLMIKRSKKNSLALSLTADQMVSALLDAEPPILYSEYDPTRPFSEASMMGL

LTNLADRELVHMMWAKRVPGFVDLTLHDQVHLLECAWLEILMIGLVWRSMEHPGKLLFAPNL

LLDRNQGKCVEGMVEIFDMLLATSSRFRMMNLQGEEFVCLKSIILLNSGVYTFLSSTLKSLEEKD

HIHRVLDKITDTLIHLMAKAGLTLQQQHQRLAQLLLILSHIRHMSNKRMEHLYSMKCKNVVPLY

DLLLEMLDAHRLHAPTSRGGASVEETDQSHLATAGSTSSHSLQKYYITGEAEGFPATV

SEQ ID NO: 336, ERT3 (314 aa), M543A, L544A, and V595A mutations from ER
(e.g., SEQ ID NO: 334) shown in bold, double underlined text
SAGDMRAANLWPSPLMIKRSKKNSLALSLTADQMVSALLDAEPPILYSEYDPTRPFSEASMMGL

LTNLADRELVHMMWAKRVPGFVDLTLHDQVHLLECAWLEILMIGLVWRSMEHPGKLLFAPNL

LLDRNQGKCVEGMVEIFDMLLATSSRFRMMNLQGEEFVCLKSIILLNSGVYTFLSSTLKSLEEKD

HIHRVLDKITDTLIHLMAKAGLTLQQQHQRLAQLLLILSHIRHMSNKGMEHLYSMKCKNVVPLY

DLLLEAADAHRLHAPTSRGGASVEETDQSHLATAGSTSSHSLQKYYITGEAEGFPATA
```

```
SEQ ID NO: 337, ERT (314 aa), G400V, L539A, L540A mutations from ER (e.g.,
SEQ ID NO: 334) shown in bold, double underlined text
SAGDMRAANLWPSPLMIKRSKKNSLALSLTADQMVSALLDAEPPILYSEYDPTRPFSEASMMGL

LTNLADRELVHMMWAKRVPGFVDLTLHDQVHLLECAWLEILMIGLVWRSMEHPVKLLFAPNL

LLDRNQGKCVEGMVEIFDMLLATSSRFRMMNLQGEEFVCLKSIILLNSGVYTFLSSTLKSLEEKD

HIHRVLDKITDTLIHLMAKAGLTLQQQHQRLAQLLLILSHIRHMSNKGMEHLYSMKCKNVVPLY

DAALEMLDAHRLHAPTSRGGASVEETDQSHLATAGSTSSHSLQKYYITGEAEGFPATV
```

In some embodiments of any of the aspects, the sequestering protein of the synTF polypeptide is in combination with 1, 2, 3, 4, 5, or more ligands. In some embodiments of any of the aspects, the sequestering protein of the synTF polypeptide is in combination with one ligand. In embodiments comprising multiple ligands, the multiple ligands can be different individual ligands or multiple copies of the same ligands, or a combination of the foregoing.

In some embodiments of any of the aspects, the ligand is estradiol (PubChem CID: 5757), or an analog thereof. In some embodiments of any of the aspects, the ligand is a synthetic ligand of the estrogen receptor, such as tamoxifen or a derivative thereof the ligand is selected from: tamoxifen, 4-hydroxytamoxifen (4OHT), endoxifen, and Fulvestrant, wherein binding of the ligand to the ERT (e.g., ERT2) exposes the NLS and results in nuclear translocation of the ERT. In some embodiments of any of the aspects, the ligand is 4-hydroxytamoxifen (4-OHT), shown below (PubChem CID: 449459), which can also be referred to as afimoxifene. In some embodiments of any of the aspects, the ligand is 4-Hydroxy-N-desmethyltamoxifen, shown below (PubChem CID: 10090750), which can also be referred to as endoxifen. In some embodiments of any of the aspects, the ligand is Fulvestrant shown below (PubChem CID 104741), which can also be referred to as ICI 182,780.

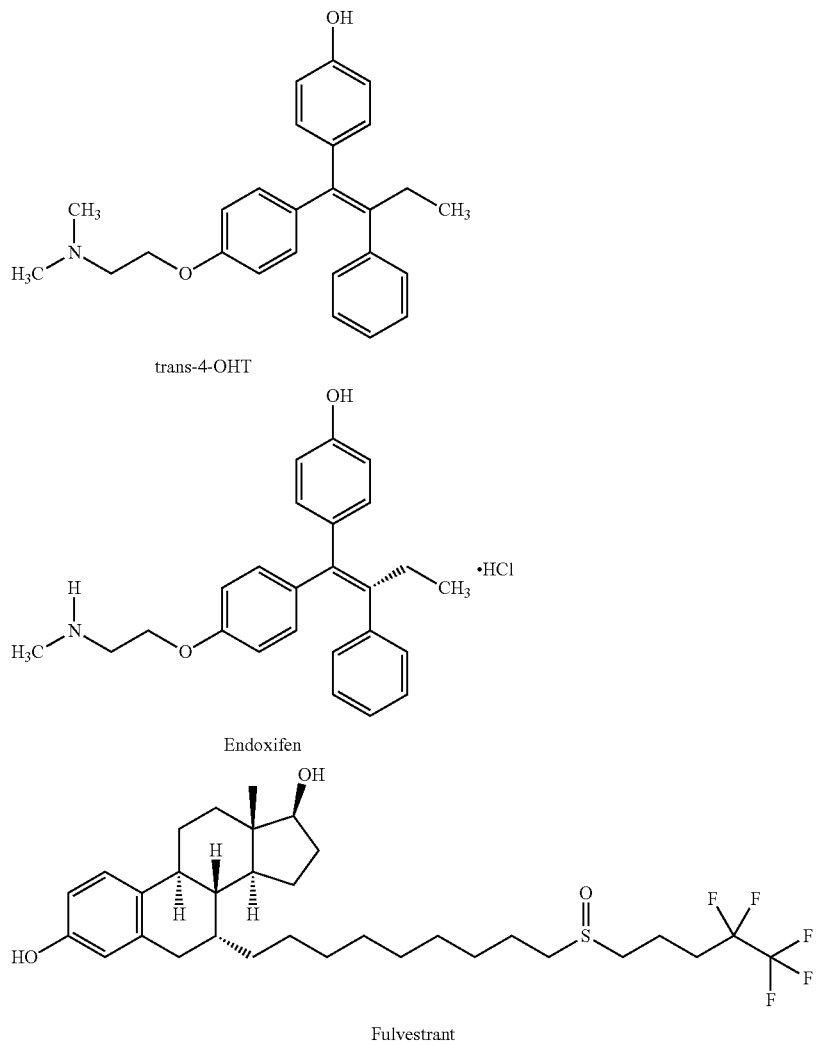

trans-4-OHT

Endoxifen

Fulvestrant

In some embodiments of any of the aspects, the sequestering protein of the synTF is a transmembrane receptor sequestering protein, and the DNA-binding domain (DBD) and transcriptional effector (TE) domain of the synTF are linked to the cytosolic side of the transmembrane domain of the receptor. In the absence of a specific ligand for the transmembrane protein, the DBD and TA of the synTF are sequestered to the cellular membrane. In the presence of a specific ligand for the transmembrane protein, the transmembrane protein cleaves itself such that the DBD and TA of the synTF are released into the cytosol to be transported to the nucleus. Non-limiting examples of transmembrane receptor sequestering protein include a synthetic notch receptor or first and second exogenous extracellular sensors, described further herein.

In some embodiments of any the aspects, the cytosolic sequestering protein comprises a Notch receptor or a variant of endogenous Notch receptor, such as a synthetic Notch (synNotch) receptor. In some embodiments of any the aspects, the synTF comprising a synNotch comprises: (a) an extracellular domain comprising a first member of a specific binding pair that is heterologous to the Notch receptor; (b) a Notch receptor regulatory region; and (c) an intracellular domain comprising the DNA binding domain and transcriptional effector domain of the synTF. In the presence of a second member of the specific binding pair, binding of the first member of the specific binding pair to the second member of the specific binding pair induces cleavage of the binding-induced proteolytic cleavage site to activate the intracellular domain, thereby permitting the synTF to translocate to the nucleus. In the absence of a second member of the specific binding pair, the synTF remains sequestered at the cellular membrane. In some embodiments of any of the aspects, the sequestering protein comprises one of SEQ ID NOs: 338-339 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 74, 335-337, that maintains the same function. See e.g., U.S. Pat. No. 10,590,182; Morsut et al., Cell. 2016 Feb. 11; 164(4):780-91; the contents of which are incorporated herein by reference in their entireties. In some embodiments of any of the aspects, the Notch receptor regulatory region comprises Lin-12 Notch repeats A-C, heterodimerization domains HD-N and HD-C, a binding-induced proteolytic cleavage site, and a transmembrane domain. In some embodiments of any the aspects, the Notch variant is a Notch receptor where the Notch extracellular subunit (NEC) (which includes the negative regulatory region (NRR)) is partially or completely removed. In some embodiments of any of the aspects, the Notch receptor regulatory region is a truncated or modified variant of synNotch, e.g., lacking one or more of the following domains: Lin-12 Notch repeats A-C, heterodimerization domains HD-N and HD-C, a binding-induced proteolytic cleavage site, the Notch extracellular domain (NEC), the negative regulatory region (NRR), or a transmembrane domain.

SEQ ID NO: 338, synNotch (306 aa)
PPQIEEACELPECQVDAGNKVCNLQCNNHACGWDGGDCSLNFNDPWKNCT

QSLQCWKYFSDGHCDSQCNSAGCLFDGFDCQLTEGQCNPLYDQYCKDHFS

DGHCDQGCNSAECEWDGLDCAEHVPERLAAGTLVLVVLLPPDQLRNNSFH

-continued
FLRELSHVLHTNVVFKRDAQGQQMIFPYYGHEEELRKHPIKRSTVGWATS

SLLPGTSGGRQRRELDPMDIRGSIVYLEIDNRQCVQSSSQCFQSATDVAA

FLGALASLGSLNIPYKIEAVKSEPVEPPLPSQLHLMYVAAAAFVLLFFVG

CGVLLS

SEQ ID NO: 339, synNotch (358 aa)
PCVGSNPCYNQGTCEPTSENPFYRCLCPAKFNGLLCHILDYSFTGGAGRD

IPPPQIEEACELPECQVDAGNKVCNLQCNNHACGWDGGDCSLNFNDPWKN

CTQSLQCWKYFSDGHCDSQCNSAGCLFDGFDCQLTEGQCNPLYDQYCKDH

FSDGHCDQGCNSAECEWDGLDCAEHVPERLAAGTLVLVVLLPPDQLRNNS

FHFLRELSHVLHTNVVFKRDAQGQQMIFPYYGHEEELRKHPIKRSTVGWA

TSSLLPGTSGGRQRRELDPMDIRGSIVYLEIDNRQCVQSSSQCFQSATDV

AAFLGALASLGSLNIPYKIEAVKSEPVEPPLPSQLHLMYVAAAAFVLLFF

VGCGVLLS

Suitable first members of a specific binding pairs (e.g., of the synNotch) include, but are not limited to, antibody-based recognition scaffolds; antibodies (i.e., an antibody-based recognition scaffold, including antigen-binding antibody fragments); non-antibody-based recognition scaffolds; antigens (e.g., endogenous antigens; exogenous antigens; etc.); a ligand for a receptor; a receptor; a target of a non-antibody-based recognition scaffold; an Fc receptor (e.g., FcγRIIIa; FcγRIIIb; etc.); an extracellular matrix component; and the like.

Specific binding pairs (e.g., of the synNotch) include, e.g., antigen-antibody specific binding pairs, where the first member is an antibody (or antibody-based recognition scaffold) that binds specifically to the second member, which is an antigen, or where the first member is an antigen and the second member is an antibody (or antibody-based recognition scaffold) that binds specifically to the antigen; ligand-receptor specific binding pairs, where the first member is a ligand and the second member is a receptor to which the ligand binds, or where the first member is a receptor, and the second member is a ligand that binds to the receptor; non-antibody-based recognition scaffold-target specific binding pairs, where the first member is a non-antibody-based recognition scaffold and the second member is a target that binds to the non-antibody-based recognition scaffold, or where the first member is a target and the second member is a non-antibody-based recognition scaffold that binds to the target; adhesion molecule-extracellular matrix binding pairs; Fc receptor-Fc binding pairs, where the first member comprises an immunoglobulin Fc that binds to the second member, which is an Fc receptor, or where the first member is an Fc receptor that binds to the second member which comprises an immunoglobulin Fc; and receptor-co-receptor binding pairs, where the first member is a receptor that binds specifically to the second member which is a co-receptor, or where the first member is a co-receptor that binds specifically to the second member which is a receptor.

In some embodiments of any the aspects, the transmembrane receptor sequestering protein comprises first and second exogenous extracellular sensors, wherein said first exogenous extracellular sensor comprises: (a) a ligand binding domain, (b) a transmembrane domain, (c) a protease cleavage site, and (d) the DBD and TA of the synTF; and wherein said second exogenous extracellular sensor comprises: (e) a ligand binding domain, (f) a transmembrane domain, and (g) a protease domain. Such a system can also be referred to as a modular extracellular sensor architecture (MESA) system. In the presence of a ligand for the first and second exogenous extracellular sensors, the two receptors are brought into proximity, permitting the protease to cleave the protease cleavage site and release the DBD and TA of the synTF into the cytosol to be translocated to the nucleus. In the absence of a ligand for the first and second exogenous extracellular sensors, the DBD and TA of the synTF remains sequestered at the cell membrane. In some embodiments of any of the aspects, the protease comprises any protease as described herein (e.g., NS3), and the protease cleavage site comprises an NS3 protease cleavage site as described herein. See e.g., US Patent Application 2014/0234851; Daringer et al., ACS Synth. Biol. 2014, 3, 12, 892-902.

Any type of suitable ligand binding domain (LB) can be employed with transmembrane receptor sequestering protein. Ligand binding domains can, for example, be derived from either an existing receptor ligand-binding domain or from an engineered ligand binding domain. Existing ligand-binding domains could come, for example, from cytokine receptors, chemokine receptors, innate immune receptors (TLRs, etc.), olfactory receptors, steroid and hormone receptors, growth factor receptors, mutant receptors that occur in cancer, neurotransmitter receptors. Engineered ligand-binding domains can be, for example, single-chain antibodies (see scFv constructs discussion below), engineered fibronectin based binding proteins, and engineered consensus-derived binding proteins (e.g., based upon leucine-rich repeats or ankyrin-rich repeats, such as DARPins). The ligand can be any cognate ligand of such ligand-binding domains.

Linker Peptide

In several aspects, described herein are synTF polypeptides comprising at least one linker peptide. As used herein "linker peptide" (used interchangeably with "peptide linker") refers to an oligo- or polypeptide region from about 2 to 100 amino acids in length, which links together any of the sequences of the polypeptides as described herein. In some embodiment, linkers can include or be composed of flexible residues such as glycine and serine so that the adjacent protein domains are free to move relative to one another. Longer linkers may be used when it is desirable to ensure that two adjacent domains do not sterically interfere with one another. Linkers may be cleavable or non-cleavable.

In some embodiments of any of the aspects, a synTF polypeptide as described herein (or a synTF polypeptide system collectively) comprises 1, 2, 3, 4, 5, or more linker peptide(s). In some embodiments of any of the aspects, the synTF polypeptide or system comprises one linker peptide. In embodiments comprising multiple linker peptides, the multiple linker peptides can be different individual linker peptides or multiple copies of the same linker peptide, or a combination of the foregoing. In some embodiments of any of the aspects, the linker peptide can be positioned anywhere, between any two domains as described herein: e.g., between the DBD and the regulator protein, between the regulator protein and the effector domain, between the DBD and effector domain, or any combination thereof. In some embodiments of any of the aspects, the linker peptide can be positioned within the DBD, effector domain, or regulator protein, e.g., to link constituents of the domain.

In some embodiments of any one aspects described herein, the linkers connect several ZFs to each other in tandem to form a ZF array. In some embodiments of any one aspects described herein, the linker connects a first ZFA with a second ZFA. In some embodiments of any one aspects described herein, the linkers connect several ZFAs to each other to in tandem to form a ZF-containing ZF protein domain. Non-limiting examples of peptide linker molecules useful in the polypeptides described herein include glycine-rich peptide linkers (see, e.g., U.S. Pat. No. 5,908,626), wherein more than half of the amino acid residues are glycine. Preferably, such glycine-rich peptide linkers consist of about 20 or fewer amino acids. A linker molecule may also include non-peptide or partial peptide molecules. For instance, the peptides can be linked to peptides or other molecules using well known cross-linking molecules such as glutaraldehyde or EDC (Pierce, Rockford, Ill.). In some embodiments of the engineered synTFs described herein, the ZF arrays (ZFAs) in the ZF protein domain of the synTF are joined together in the respective fusion protein with a linker peptide.

Non-limiting examples of linker peptide include, but are not limited to: PGER (SEQ ID NO: 340), TGSQK (SEQ ID NO: 341), TGEKP (SEQ ID NO: 342), THLR (SEQ ID NO: 343), TGGGEKP (SEQ ID NO: 344), FHYDRNNIA-VGADESVVKEAH-REVINSSTEGLLLNIDKDIRKILSGYIVEIEDTE (SEQ ID NO: 345); VEIEDTE (SEQ ID NO: 346), KDIRKILSGYIVEIEDTE (SEQ ID NO: 347); STEGLLLNIDKDIRKILSGYIVEIEDTE (SEQ ID NO: 348), EVKQENRLLNESES (SEQ ID NO: 349); VGADESVVKEAH-REVINSSTEGLLLNIDKDIRKILSGYIVEIEDTE (SEQ ID NO: 350); GGSGG (SEQ ID NO: 67); GGGSG (SEQ ID NO: 70); CVRGS (SEQ ID NO: 73), GGGGSG (SEQ ID NO: 75), GSGSGSAC (SEQ ID NO: 100), LEGGGGSGG (SEQ ID NO: 103), GGGGSGGT (SEQ ID NO: 104), SGGGSGGSGSS (SEQ ID NO: 345); PGAGSSGDIM (SEQ ID NO: 88) GSSGTGSGSGTS (SEQ ID NO: 90); SGTS (SEQ ID NO: 277); GSGS (SEQ ID NO: 278), GGSGGS (SEQ ID NO: 303), and GSSGSS (SEQ ID NO: 323).

For examples, TGSQK (SEQ ID NO: 341) or TGEKP (SEQ ID NO: 342) or TGGGEKP (SEQ ID NO: 344) is used as linker between ZFAs; VEIEDTE (SEQ ID NO: 346), GGSGGS (SEQ ID NO: 303), GGSGG (SEQ ID NO: 67), GGGSG (SEQ ID NO: 70), CVRGS (SEQ ID NO: 73), GGGGSG (SEQ ID NO: 75), GSGSGSAC (SEQ ID NO: 100), LEGGGGSGG (SEQ ID NO: 103), GGGGSGGT (SEQ ID NO: 104), SGGGSGGSGSS (SEQ ID NO: 345) are used to link ZF domains and effector domains together; PGAGSSGDIM (SEQ ID NO: 88) GSSGTGSGSGTS (SEQ ID NO: 90); SGTS (SEQ ID NO: 277); GSGS (SEQ ID NO: 278), GSSGSS (SEQ ID NO: 323) are used to link regions of a SMASh domain, a StaPL domain, or an NS3/NS4a domain, described further herein.

Flexible linkers are generally composed of small, non-polar or polar residues such as Gly, Ser and Thr. In one embodiment of any fusion protein described herein that includes a linker, the linker peptide comprises at least one amino acid that is Gly or Ser. In one embodiment of a fusion protein described herein that includes a linker, the linker is a flexible polypeptide between 1 and 25 residues in length. Common examples of flexible peptide linkers include (GGS)n, where n=1 to 8 (SEQ ID NO: 351, GGSGGSGGSGGSGGSGGSGGSGGS), or (Gly4Ser)n repeat where n=1-8 (SEQ ID NO: 352, GGGGSGGGGSGGGGSGGGGSGGGGSGGGGSGG-GGSGGGGS), preferably, n=3, 4, 5, or 6, that is (Gly-Gly-Gly-Gly-Ser)n (SEQ ID NO: 353), GGGGS, where n indicates the number of repeats of the motif. For example, the flexible linker is (GGS)₂ (SEQ ID NO: 354, GGSGGS). Alternatively, flexible peptide linkers include Gly-Ser repeats (Gly-Ser)$_p$ where p indicates the number of Gly-Ser repeats of the motif, p=1-8 (SEQ ID NO: 355 GSGSGSGSGSGSGSGS), preferably, n=3, 4, 5, or 6. Another example of a flexible linker is TGSQK (SEQ ID NO: 341).

In one embodiment of the engineered synTFs described herein, wherein the ZF protein domains and effector domains are joined together with a linker peptide, the linker peptide is about 1-20 amino acids long. In one embodiment, the linker peptide does not comprise Lys, or does not comprise, or does not comprise both Lys and Arg.

In some embodiments of the engineered synTFs described herein, the ZF protein domains and effector domains are joined together chemical cross-linking agents. Bifunctional cross-linking molecules are linker molecules that possess two distinct reactive sites. For example, one of the reactive sites of a bifunctional linker molecule may be reacted with a functional group on a peptide to form a covalent linkage and the other reactive site may be reacted with a functional group on another molecule to form a covalent linkage. General methods for cross-linking molecules have been reviewed (see, e.g., Means and Feeney, Bioconjugate Chem., 1: 2-12 (1990)).

Homobifunctional cross-linker molecules have two reactive sites which are chemically the same. Non-limiting examples of homobifunctional cross-linker molecules include, without limitation, glutaraldehyde; N,N'-bis(3-maleimido-propionyl-2-hydroxy-1,3-propanediol (a sulfhydryl-specific homobifunctional cross-linker); certain N-succinimide esters (e.g., discuccinimyidyl suberate, dithiobis (succinimidyl propionate), and soluble bis-sulfonic acid and salt thereof (see, e.g., Pierce Chemicals, Rockford, Ill.; Sigma-Aldrich Corp., St. Louis, Mo.).

A bifunctional cross-linker molecule is a heterobifunctional linker molecule, meaning that the linker has at least two different reactive sites, each of which can be separately linked to a peptide or other molecule. Use of such heterobifunctional linkers permits chemically separate and stepwise addition (vectorial conjunction) of each of the reactive sites to a selected peptide sequence. Heterobifunctional linker molecules useful in the disclosure include, without limitation, m-maleimidobenzoyl-N-hydroxysuccinimide ester (see, Green et al., Cell, 28: 477-487 (1982); Palker et al., Proc. Natl. Acad. Sci (USA), 84: 2479-2483 (1987)); m-maleimido-benzoylsulfosuccinimide ester; maleimidobutyric acid N-hydroxysuccinimide ester; and N-succinimidyl 3-(2-pyridyl-dithio)propionate (see, e.g., Carlos et al., Biochem. J., 173: 723-737 (1978); Sigma-Aldrich Corp., St. Louis, Mo.).

In some embodiments of any aspect described herein, in the synTF described or the ZF-containing fusion protein described herein, all the helices within a ZFA are linked by peptide linkers (L2) having four to six amino acid residues.

In some embodiments of any aspect described herein, in the synTF described or the ZF-containing fusion protein described herein, all the helices within an individual ZFA are linked by rigid peptide linkers such as TGEKP (SEQ ID NO: 342) or TGSKP (SEQ ID NO: 356) or TGQKP (SEQ ID NO: 357) or TGGKP (SEQ ID NO: 358). The rigid linker aids in conferring synergistic binding of the ZF motifs to its target DNA sequence.

In one embodiment of any aspect described herein, in the synTF described or the ZF containing fusion protein described herein, the ($L_1$) or ($L_2$) is a flexible linker. Non-limiting examples include: TGSQKP (SEQ ID NO: 359) and TGGGEKP (SEQ ID NO: 344). In one embodiment, the linker flexible peptide is 1-20 amino acids long. The flexible linker aid in weakening cooperativity between adjacent ZF motifs.

In one embodiment of any aspect described herein, in the synTF described or the ZF containing fusion protein described herein, the (L1) or (L2) is a rigid linker. Non-limiting examples include: TGEKP (SEQ ID NO: 342), TGSKP (SEQ ID NO: 356), TGQKP (SEQ ID NO: 357) and TGGKP (SEQ ID NO: 358).

In some embodiments of any aspect described herein, in the synTF described or the ZF containing fusion protein described herein, where there are two or more ZFAs, the individual ZFAs are linked by flexible peptide linkers, such as TGSQKP (SEQ ID NO: 359). In another embodiment, the ZFAs are linked by chemical crosslinkers. Chemical crosslinkers are known in the art.

In some embodiments of any aspect described herein, in the synTF described or the ZF containing fusion protein described herein, all the helices within an individual ZFA are linked by a combination of rigid peptide linkers and flexible peptide linkers. In some embodiments of any of the aspects, the rigid peptide linkers and flexible peptide linkers are used alternatingly to connect the fingers.

Self-Cleaving Peptide

In several aspects, described herein are synTF polypeptides comprising a self-cleaving peptide. As used herein, the term "self-cleaving peptide" refers to a short amino acid sequence (e.g., approximately 18-22 aa-long peptides) that can catalyze its own cleavage. In some embodiments of any of the aspects, a multi-component synTF system as described herein (e.g., induced proximity synTF system) comprises at least two polypeptides that are physically linked to one another through a self-cleaving peptide domain. The self-cleaving peptide allows the nucleic acids of the first polypeptide and second polypeptide (and/or third polypeptide, etc.) to be present in the same vector, but after translation the self-cleaving peptide cleaves the translated polypeptide into the multiple separate polypeptides.

In some embodiments of any of the aspects, a synTF polypeptide as described herein (or a synTF polypeptide system collectively) comprises 1, 2, 3, 4, 5, or more self-cleaving peptides, e.g., in between each synTF polypeptide. In some embodiments of any of the aspects, the synTF polypeptide or system comprises one self-cleaving peptide, e.g., in between a first polypeptide and a second polypeptide of a synTF polypeptide system. In embodiments comprising multiple self-cleaving peptides, the multiple self-cleaving peptides can be different individual self-cleaving peptides or multiple copies of the same self-cleaving peptide, or a combination of the foregoing.

In some embodiments, self-cleaving peptides are used, for example, in heterodimerization domain synTFs. As a non-limiting example, FIGS. 19 and 20 show a 2A self-cleaving peptide in between a first polypeptide region comprising [ABI]-[ZF] and a second polypeptide region comprising [ED]-[PYL]. Following translation of the polypeptide, the 2A sequence, which is a self-cleaving peptide, cleaves the polypeptide into two polypeptides: [ABI]-[ZF] and [ED]-[PYL], which in the presence of ABA can form a [ED]-[PYL]•ABA•[ABI]-[ZF] complex, thus coupling the DBD (ZF) and ED (e.g., p65 or KRAB).

In some embodiments of any of the aspects, the self-cleaving peptide belongs to the 2A peptide family, which can also be referred to as a 2A Ribosomal Skip Sequence. Non-limiting examples of 2A peptides include P2A, E2A, F2A and T2A (see e.g., Table 18). F2A is derived from foot-and-mouth disease virus 18; E2A is derived from equine rhinitis A virus; P2A is derived from porcine teschovirus-1 2A; T2A is derived from thosea asigna virus 2A. In some embodiments of any of the aspects, the N-terminal of the 2A peptide comprises the sequence "GSG" (Gly-Ser-Gly). In some embodiments of any of the aspects, the N-terminal of the 2A peptide does not comprise the sequence "GSG" (Gly-Ser-Gly).

TABLE 18

Exemplary Self-Cleaving Peptides

| SEQ ID NO: | Name | Sequence |
|---|---|---|
| 360 | T2A | (GSG)EGRGSLLTCGDVEENPGP |
| 68 | P2A | (GSG)ATNFSLLKQAGDVEENPGP |
| 361 | E2A | (GSG)QCTNYALLKLAGDVESNPGP |
| 362 | F2A | (GSG)VKQTLNFDLLKLAGDVESNPGP |

The 2A-peptide-mediated cleavage commences after protein translation. The cleavage is triggered by breaking of peptide bond between the Proline (P) and Glycine (G) in the C-terminal of the 2A peptide. The molecular mechanism of 2A-peptide-mediated cleavage involves ribosomal "skipping" of glycyl-prolyl peptide bond formation rather than true proteolytic cleavage. Different 2A peptides have different efficiencies of self-cleaving, with P2A being the most efficient and F2A the least efficient. Therefore, up to 50% of F2A-linked proteins can remain in the cell as a fusion protein.

In some embodiments of any of the aspects, the self-cleaving peptide of a synTF polypeptide system as described herein comprises SEQ ID NOs: 68, 360-362, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 68, 360-362, that maintains the same function (e.g., self-cleavage).

In some embodiments of any of the aspects, providing the multiple polypeptides of the synTF systems as described herein in a 1:1 (or 1:1:1, etc.) stoichiometric ratio is advantageous (e.g., this stoichiometric ratio results in optimal functionality). In embodiments where a 1:1 (or 1:1:1, etc.) ratio of the first and second (and third etc.) polypeptides of a synTF system is advantageous, then the first and second polypeptides can be provided in a single vector, flanking a self-cleaving peptide(s) as described herein. In embodiments where a 1:1 (or 1:1:1, etc.) ratio of the first and second (and third etc.) polypeptides of a synTF system is not advantageous (e.g., this stoichiometric ratio results in suboptimal functionality, and other ratios result in optimal functionality) then the first and second polypeptides can be provided in multiple separate vectors, e.g., at the desired stoichiometric ratios.

Detectable Marker

In several aspects, described herein are synTF polypeptides comprising at least one detectable marker. As used herein, the term "detectable marker" refers to a moiety that, when attached to the synTF polypeptide, confers detectability upon that polypeptide or another molecule to which the polypeptide binds. In some embodiments of any of the aspects, the synTF polypeptide (or the synTF polypeptide system collectively) comprises 1, 2, 3, 4, 5, or more detectable markers. In some embodiments of any of the aspects, the synTF polypeptide or system comprises one detectable marker. In embodiments comprising multiple detectable markers, the multiple detectable markers can be different individual detectable markers or multiple copies of the same detectable markers, or a combination of the foregoing.

In some embodiments of any of the aspects, fluorescent moieties can be used as detectable markers, but detectable markers also include, for example, isotopes, fluorescent proteins and peptides, enzymes, components of a specific binding pair, chromophores, affinity tags as defined herein, antibodies, colloidal metals (i.e. gold) and quantum dots. Detectable markers can be either directly or indirectly detectable. Directly detectable markers do not require additional reagents or substrates in order to generate detectable signal. Examples include isotopes and fluorophores. Indirectly detectable markers require the presence or action of one or more co-factors or substrates. Examples include enzymes such as β-galactosidase which is detectable by generation of colored reaction products upon cleavage of substrates such as the chromogen X-gal (5-bromo-4-chloro-3-indoyl-β-D-galactopyranoside), horseradish peroxidase which is detectable by generation of a colored reaction product in the presence of the substrate diaminobenzidine and alkaline phosphatase which is detectable by generation of colored reaction product in the presence of nitroblue tetrazolium and 5-bromo-4-chloro-3-indolyl phosphate, and affinity tags. Non-limiting examples of affinity tags include Strep-tags, chitin binding proteins (CBP), maltose binding proteins (MBP), glutathione-S-transferase (GST), FLAG-tags, HA-tags, Myc-tags, poly(His)-tags as well as derivatives thereof. In some embodiments of any of the aspects, the detectable marker is selected from GFP, V5, HAL Myc, VSV-G, HSV, FLAG, HIS, mCherry, AU1, and biotin.

SEQ ID NO: 65, NLS,
PKKKRKV

SEQ ID NO: 77, 3X FLAG Tag + Nuclear Localization Sequence (in bold text)
DYKDHDGDYKDHDIDYKDDDDKMAPKKKRKVGIHGVPGG SEQ ID NO: 80, AU1 tag,
DTYRYI SEQ ID NO: 84, HA tag,
YPYDVPDYA SEQ ID NO: 89, FLAG Tag,
DYKDDDDK SEQ ID NO: 372, mCherry:
VSKGEEDNMAIIKEFMRFKVHMEGSVNGHEFEIEGEGEGRPYEGTQTAK

LKVTKGGPLPFAWDILSPQFMYGSKAYVKHPADIPDYLKLSFPEGFKWE

RVMNFEDGGVVTVTQDSSLQDGEFIYKVKLRGTNFPSDGPVMQKKTMGW

QASSERMYPEDGALKGEIKQRLKLKDGGHYDAEVKTTYKAKKPVQLPGA

YNVNIKLDITSHNEDYTIVEQYERAEGRHSTGGMDELYK

SEQ ID NO: 376, huEGFRt (a truncated human EGFR polypeptide)
RKVCNGIGIGEFKDSLSINATNIKHFKNCTSISGDLHILPVAFRGDSFT

HTPPLDPQELDILKTVKEITGFLLIQAWPENRTDLHAFENLEIIRGRTK

QHGQFSLAVVSLNITSLGLRSLKEISDGDVIISGNKNLCYANTINWKKL

FGTSGQKTKIISNRGENSCKATGQVCHALCSPEGCWGPEPRDCVSCRNV

SRGRECVDKCNLLEGEPREFVENSECIQCHPECLPQAMNITCTGRGPDN

-continued
CIQCAHYIDGPHCVKTCPAGVMGENNTLVWKYADAGHVCHLCHPNCTYG

CTGPGLEGCPTNGPKIPSIATGMVGALLLLLVVALGIGLFM

In some embodiments of any of the aspects, the detectable marker of a synTF polypeptide as described herein comprises SEQ ID NOs: 65, 77, 80, 80, 89, 372, 376, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 65, 77, 80, 80, 89, 372, or 376, that maintains the same (e.g., detection of the synTF polypeptide or cleaved fragments of the synTF polypeptide).

In some embodiments of any of the aspects, the detectable marker can be located anywhere within a synTF polypeptide as described herein. In one embodiment, the detectable marker is located between any domain of a synTF polypeptide as described herein, but is not found within a functional domain or does not disrupt the function of a domain. In some embodiments of any of the aspects, the detectable marker is located adjacent to and C terminal of the extracellular binding domain. Such a marker can be used to detect the expression of the synTF polypeptide, including cytosolic expression or nuclear translocation.

In some embodiments of any of the aspects, the detectable marker is located between the repressible protease and a protease cleavage site; such a marker can be used to detect the cleavage and/or expression of the synTF polypeptide. In some embodiments of any of the aspects, the detectable marker that is located between the repressible protease and a protease cleavage site comprises the AU1 tag, the HA1 tag, or any other marker as described herein.

In some embodiments of any of the aspects, the detectable marker is located adjacent and N-terminal to the repressible protease. In some embodiments of any of the aspects, the detectable marker is located adjacent and N-terminal to the repressible protease and C-terminal to a first protease cleavage site. In some embodiments of any of the aspects, the detectable marker is located adjacent to and C terminal to the repressible protease. In some embodiments of any of the aspects, the detectable marker is located adjacent to and C terminal to the repressible protease and N-terminal to a second protease cleavage site.

In some embodiments of any of the aspects, the detectable marker is located at the C-terminal end of the polypeptide. Such a marker can be used to detect the intracellular expression of the synTF polypeptide. In some embodiments of any of the aspects, the detectable marker located at the C-terminal end of the polypeptide comprises mCherry or another marker as described herein.

In some embodiments of any of the aspects, synTF polypeptides as described herein, especially those that are administered to a subject or those that are part of a pharmaceutical composition, do not comprise detectable markers that are immunogenic. In some embodiments of any of the aspects, synTF polypeptides as described herein do not comprise GFP, mCherry, HAL or any other immunogenic markers.

II. Inducible Synthetic Transcription Factors

In multiple aspects described herein are synthetic transcription factors comprising: (a) at least one DNA binding domain (DBD), (b) a transcriptional effector domain (ED), and (c) at least one regulator protein (RP). In some embodiments of any of the aspects, the ED is directly coupled or linked to the DBD. In some embodiments of any of the aspects, the ED is indirectly coupled or linked to the DBD. In some embodiments of any of the aspects, the coupling of the ED to the DBD is regulated by the at least one RP. In some embodiments of any of the aspects, the cellular localization of the ED is regulated by the at least one regulator protein. In some embodiments of any of the aspects, at least one regulator protein is selected from the group consisting of repressible protease, induced degradation domain, induced proximity domain, and cytosolic sequestering domain.

In some embodiments of any of the aspects, the domains of the synTF can be in order, e.g., from N-terminus to C-terminus: DBD-ED-RP; DBD-RP-ED; ED-DBD-RP; ED-RP-DBD; RP-DBD-ED; or RP-ED-DBD. In embodiments comprising two regulator proteins (i.e., RP1 and RP2), the domains of the synTF can be in order, e.g., from N-terminus to C-terminus: DBD-ED-RP1-RP2; ED-DBD-RP1-RP2; RP1-DBD-ED-RP2; DBD-RP1-ED-RP2; ED-RP1-DBD-RP2; RP1-ED-DBD-RP2; RP1-ED-RP2-DBD; ED-RP1-RP2-DBD; RP2-RP1-ED-DBD; RP1-RP2-ED-DBD; ED-RP2-RP1-DBD; RP2-ED-RP1-DBD; RP2-DBD-RP1-ED; DBD-RP2-RP1-ED; RP1-RP2-DBD-ED; RP2-RP1-DBD-ED; DBD-RP1-RP2-ED; RP1-DBD-RP2-ED; ED-DBD-RP2-RP1; DBD-ED-RP2-RP1; RP2-ED-DBD-RP1; ED-RP2-DBD-RP1; DBD-RP2-ED-RP1; and RP2-DBD-ED-RP1.

In some embodiments and by way of an example only, an exemplary RP1 is selected from an induced proximity domain (IPD), or cytosolic sequestering domain (CS), and the RP2 is selected from the induced degradation domain (comprising a SMASh domain), as disclosed herein. In another embodiment, an exemplary RP1 is an induced degradation domain (comprising a SMASh domain) and the PR2 is selected from an induced proximity domain (IPD) or a cytosolic sequestering domain (IPD).

In multiple aspects, described herein are exemplary synTF polypeptides. In some embodiments of any of the aspects, a synTF polypeptide comprises one of SEQ ID NOs: 4-15, 40-51, or 378-379, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 4-15, 40-51, or 378-379.

A. Repressible Protease SynTF

In some embodiments of any of the aspects, the regulator protein is a repressible protease. Accordingly, in one aspect described herein is a synTF comprising: (a) a DBD; (b) an ED; and (c) a repressible protease domain (referred to herein as a PRO or RPD). In some embodiments of any of the aspects, the domains of the synTF can be in order, e.g., from N-terminus to C-terminus: DBD-ED-PRO; DBD-PRO-ED; ED-DBD-PRO; ED-PRO-DBD; PRO-DBD-ED; or PRO-ED-DBD.

In some embodiments of any of the aspects, the repressible protease synTF further comprises at least one protease cleavage site (PC), as described further herein. In a preferred embodiment, the at least one protease cleavage site is located in between the DBD and ED, such that when the protease cleaves at the protease cleavage site, the DBD and ED are uncoupled. Accordingly, in some embodiments, the repressible protease synTF comprises from N-terminus to C-terminus: PRO-ED-PC-DBD; ED-PRO-PC-DBD; ED-PC-PRO-DBD; DBD-PC-PRO-ED; DBD-PRO-PC-ED; PRO-DBD-PC-ED; ED-PC-DBD-PRO; and DBD-PC-ED-PRO.

In some embodiments of any of the aspects, the repressible protease synTF comprises two protease cleavage sites (PC). In some embodiments of any of the aspects, the two protease cleavage sites are located directly N terminal and C terminal of the repressible protease domain, e.g., from N-terminus to C-terminus: PC1-PRO-PC2. In some embodiments of any of the aspects, the repressible protease synTF comprises from N-terminus to C-terminus: DBD-PC1-PRO-PC2-ED, or ED-PC1-PRO-PC2-DBD.

In some embodiments of any of the aspects, the repressible protease synTF further comprises a cofactor for the repressible protease (CO), as described further herein. In some embodiments of any of the aspects, the cofactor for the repressible protease is directly linked to the repressible protease, e.g., from N-terminus to C-terminus: CO-PRO or PRO-CO. In some embodiments of any of the aspects, the repressible protease synTF comprises from N-terminus to C-terminus: DBD-ED-PRO-CO; DBD-PRO-CO-ED; ED-DBD-PRO-CO; ED-PRO-CO-DBD; PRO-CO-DBD-ED; PRO-CO-ED-DBD; DBD-ED-CO-PRO; DBD-CO-PRO-ED; ED-DBD-CO-PRO; ED-CO-PRO-DBD; CO-PRO-DBD-ED; CO-PRO-ED-DBD; DBD-PC1-PRO-CO-PC2-ED; ED-PC1-PRO-CO-PC2-DBD; DBD-PC1-CO-PRO-PC2-ED; or ED-PC1-CO-PRO-PC2-DBD.

In some embodiments of any of the aspects, the DBD of the repressible protease synTF comprises ZF10-1. In some embodiments of any of the aspects, the DBD of the repressible protease synTF comprises SEQ ID NO: 3 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the SEQ ID NO: 3, that maintains the same function.

In some embodiments of any of the aspects, the effector domain (ED) comprises a transcriptional activator. In one aspect, described herein is a repressible protease synTF comprising from N-terminus to C-terminus: (a) DBD, (b) a repressible protease; and (c) a transcriptional activator domain. In some embodiments of any of the aspects, the repressible protease synTF comprises SEQ ID NOs: 8 or 44 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 8 or 44, that maintains the same function.

In some embodiments of any of the aspects, the repressible protease synTF is encoded by a vector or polynucleotide comprising SEQ ID NOs: 20 or 32 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 20 or 32, that maintains the same function of the encoded polypeptide, or a codon-optimized version of SEQ ID NOs: 20 or 32.

In some embodiments of any of the aspects, the effector domain (ED) comprises a transcriptional repressor. In one aspect, described herein is a repressible protease synTF comprising from N-terminus to C-terminus: (a) a transcriptional repressor domain, (b) a repressible protease; and (c) DBD. In some embodiments of any of the aspects, the repressible protease synTF comprises SEQ ID NOs: 9 or 45 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 9 or 45, that maintains the same function.

In some embodiments of any of the aspects, the repressible protease synTF is encoded by a vector or polynucleotide comprising SEQ ID NOs: 21 or 33 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 21 or 33, that maintains the same function of the encoded polypeptide, or a codon-optimized version of SEQ ID NOs: 21 or 33.

B. Induced Degradation Domain SynTF

In some embodiments of any of the aspects, the regulator protein is an induced degradation domain. Accordingly, in one aspect described herein is a synTF comprising: (a) a DBD; (b) an ED; and (c) induced degradation domain (SMASh). As described herein, the SMASh domain can be a C-terminal SMASh domain or an N-terminal SMASh domain. In some embodiments of any of the aspects, the domains of the synTF can be in order, e.g., from N-terminus to C-terminus: DBD-ED-SMASh; ED-DBD-SMASh; SMASh-DBD-ED; or SMASh-ED-DBD.

In some embodiments of any of the aspects, the DBD of the SMASh synTF comprises ZF10-1. In some embodiments of any of the aspects, the DBD of the SMASh synTF comprises SEQ ID NO: 3 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the SEQ ID NO: 3, that maintains the same function.

In some embodiments of any of the aspects, the effector domain (ED) comprises a transcriptional activator. In one aspect, described herein is a SMASh synTF comprising from N-terminus to C-terminus: (a) DBD, (b) a transcriptional activator domain, and (c) an induced degradation (e.g., SMASh) domain. In some embodiments of any of the aspects, the SMASh synTF comprises SEQ ID NOs: 12 or 48 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 12 or 48, that maintains the same function.

In some embodiments of any of the aspects, the SMASh synTF is encoded by a vector or polynucleotide comprising SEQ ID NOs: 24 or 36 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 24 or 36, that maintains the same function of the encoded polypeptide, or a codon-optimized version of SEQ ID NOs: 24 or 36.

In some embodiments of the aspects, the induced degradation domain synTF further comprises a second regulator protein, e.g., a cytosolic sequestering domain (CS). Accordingly, in one aspect described herein is a synTF comprising: (a) a DBD; (b) an ED; (c) induced degradation domain (SMASh); and (d) a cytosolic sequestering domain (CS). In some embodiments of any of the aspects, the synTF comprises from N-terminus to C-terminus: DBD-ED-SMASh-CS; ED-DBD-SMASh-CS; SMASh-DBD-ED-CS; DBD-SMASh-ED-CS; ED-SMASh-DBD-CS; SMASh-ED-DBD-CS; SMASh-ED-CS-DBD; ED-SMASh-CS-DBD;

CS-SMASh-ED-DBD; SMASh-CS-ED-DBD; ED-CS-SMASh-DBD; CS-ED-SMASh-DBD; CS-DBD-SMASh-ED; DBD-CS-SMASh-ED; SMASh-CS-DBD-ED; CS-SMASh-DBD-ED; DBD-SMASh-CS-ED; SMASh-DBD-CS-ED; ED-DBD-CS-SMASh; DBD-ED-CS-SMASh; CS-ED-DBD-SMASh; ED-CS-DBD-SMASh; DBD-CS-ED-SMASh; and CS-DBD-ED-SMASh. In preferred embodiments, the SMASh domain is at the C-terminus or N-terminus: e.g., SMASh-DBD-ED-CS; SMASh-ED-DBD-CS; SMASh-ED-CS-DBD; SMASh-CS-ED-DBD; SMASh-CS-DBD-ED; SMASh-DBD-CS-ED; ED-DBD-CS-SMASh; DBD-ED-CS-SMASh; CS-ED-DBD-SMASh; ED-CS-DBD-SMASh; DBD-CS-ED-SMASh; and CS-DBD-ED-SMASh.

In some embodiments of any of the aspects, the DBD of the SMASh/cytosolic sequestering synTF comprises ZF3-5. In some embodiments of any of the aspects, the DBD of the SMASh/cytosolic sequestering synTF comprises SEQ ID NO: 2 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the SEQ ID NO: 2, that maintains the same function.

In some embodiments of any of the aspects, the effector domain (ED) comprises a transcriptional activator. In one aspect, described herein is a SMASh/cytosolic sequestering synTF comprising from N-terminus to C-terminus: (a) DBD, (b) a transcriptional activator domain, (c) a cytosolic sequestering domain, and (d) an induced degradation (e.g., SMASh) domain. In another aspect, described herein is a SMASh/cytosolic sequestering synTF comprising from N-terminus to C-terminus: (a) an induced degradation (e.g., SMASh) domain, (b) DBD, (c) a transcriptional activator domain, and (d) a cytosolic sequestering domain. In some embodiments of any of the aspects, the SMASh/cytosolic sequestering synTF comprises SEQ ID NOs: 10, 11, 46, 47, or 379 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 10, 11, 46, 47, or 379 that maintains the same function.

In some embodiments of any of the aspects, the SMASh/cytosolic sequestering synTF is encoded by a vector or polynucleotide comprising SEQ ID NOs: 22, 23, 34, or 35 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 22, 23, 34, or 35, that maintains the same function of the encoded polypeptide, or a codon-optimized version of SEQ ID NOs: 22, 23, 34, or 35.

In some embodiments of any of the aspects, the effector domain (ED) comprises a transcriptional repressor. In one aspect, described herein is a SMASh/cytosolic sequestering synTF comprising from N-terminus to C-terminus: (a) a transcriptional repressor domain, (b) DBD, (c) a cytosolic sequestering domain and (d) an induced degradation (e.g., SMASh) domain. In another aspect, described herein is a SMASh/cytosolic sequestering synTF comprising from N-terminus to C-terminus: (a) an induced degradation (e.g., SMASh) domain, (b) a transcriptional repressor domain, (c) DBD, and (d) a cytosolic sequestering domain. In some embodiments of any of the aspects, the SMASh/cytosolic sequestering synTF comprises one of SEQ ID NOs: 13-15 or 49-51 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 13-15 or 49-51, that maintains the same function.

In some embodiments of any of the aspects, the SMASh/cytosolic sequestering synTF is encoded by a vector or polynucleotide comprising one of SEQ ID NOs: 25-27 or 37-39 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 22, 23, 34, or 35, that maintains the same function of the encoded polypeptide, or a codon-optimized version of SEQ ID NOs: 25-27 or 37-39.

In some embodiments of the aspects, the induced degradation domain synTF further comprises a second regulator protein, e.g., a repressible domain (PRO). Accordingly, in one aspect described herein is a synTF comprising: (a) a DBD; (b) an ED; (c) induced degradation domain (SMASh); and (d) a repressible protease domain (PRO). In some embodiments of any of the aspects, the synTF comprises from N-terminus to C-terminus: DBD-ED-SMASh-PRO; ED-DBD-SMASh-PRO; SMASh-DBD-ED-PRO; DBD-SMASh-ED-PRO; ED-SMASh-DBD-PRO; SMASh-ED-DBD-PRO; SMASh-ED-PRO-DBD; ED-SMASh-PRO-DBD; PRO-SMASh-ED-DBD; SMASh-PRO-ED-DBD; ED-PRO-SMASh-DBD; PRO-ED-SMASh-DBD; PRO-DBD-SMASh-ED; DBD-PRO-SMASh-ED; SMASh-PRO-DBD-ED; PRO-SMASh-DBD-ED; DBD-SMASh-PRO-ED; SMASh-DBD-PRO-ED; ED-DBD-PRO-SMASh; DBD-ED-PRO-SMASh; PRO-ED-DBD-SMASh; ED-PRO-DBD-SMASh; DBD-PRO-ED-SMASh; and PRO-DBD-ED-SMASh. In some embodiments, the SMASh domain is at the C-terminus or N-terminus and the PRO domain is in between the DBD and ED domains: e.g., SMASh-ED-PRO-DBD; SMASh-DBD-PRO-ED; ED-PRO-DBD-SMASh; and DBD-PRO-ED-SMASh.

In some embodiments, the sequence of each domain is selected from exemplary domain sequences as described herein. In some embodiments, the ED of the PRO/SMASh synTF system is a transcriptional activator. In some embodiments, the ED of the PRO/SMASh synTF system is a transcriptional repressor. When a protease inhibitor for the PRO domain is present, the ED and DBD are coupled and the synTF is ON, and when protease inhibitor for the PRO domain is absent, the ED and DBD are uncoupled and the synTF is OFF. When an inducer of the induced degradation pair is present (e.g., a protease inhibitor), the PRO/SMASh synTF system is degraded. When an inducer of the induced degradation pair is absent (e.g., a protease inhibitor), the SMASh tag is degraded and the PRO/SMASh synTF system is not degraded. In some embodiments of any of the aspects, the repressible protease domain and the induced degradation domain each comprise a different protease or each comprise an NS3 protease with sensitivities to different NS3 protease inhibitors, such that a separate protease inhibitor can be used to separately regulate the PRO domain and the SMASh domain.

In some embodiments of the aspects, the induced degradation domain synTF further comprises a second regulator protein, e.g., an induced proximity pair (IPD). Accordingly, in one aspect described herein is a synTF system comprising: (a) a DBD; (b) an ED; (c) induced degradation domain (SMASh); and (d) an induced proximity pair (IPD). The induced degradation domain can be linked to either polypeptide of the IPD synTF system. In one aspect described herein is a synTF system comprising: (a) first polypeptide comprising: (i) a DBD, (ii) a first member of an induced proximity pair (IP1), and (iii) an induced degradation domain (SMASh); and (b) a second polypeptide comprising: (i) an ED and (ii) a second member of an induced proximity pair (IP2). In another aspect described herein is a synTF system comprising: (a) first polypeptide comprising: (i) a DBD and (ii) a first member of an induced proximity pair (IP1); and (b) a second polypeptide comprising: (i) an ED, (ii) a second member of an induced proximity pair (IP2), and (iii) an induced degradation domain (SMASh). In another aspect described herein is a synTF system comprising: (a) first polypeptide comprising: (i) a DBD, (ii) a first member of an induced proximity pair (IP1), and (iii) an induced degradation domain (SMASh); and (b) a second polypeptide comprising: (i) an ED, (ii) a second member of an induced proximity pair (IP2), and (iii) an induced degradation domain (SMASh). The SMASh is linked such that it does not impede binding of IPD1 and IPD2 in the presence of an inducer agent, e.g., through the use of a flexible linker peptide. Non-limiting examples of $1^{st}$ and $2^{nd}$ IPD/SMASh synTF systems are shown in Table 19.

ing: (i) an ED and (ii) a second member of an induced proximity pair (IP2). In some embodiments of any of the aspects, the domains of the synTF can be in order, e.g., from N-terminus to C-terminus: DBD-IP1 and ED-IP2; DBD-IP1 and IP2-ED; IP1-DBD and ED-IP2; or IP1-DBD and IP2-ED. That is, the DBD is attached to one member of the induced proximity pair (i.e., IP1), and the ED is attached to the other member or cognate member of the induced proximity pair (i.e., IP2), such that that when an inducer of the induced proximity pair is present, the IP1 and IP2 bind to the inducer resulting in formation of a protein complex comprising DBD-IP1:IP2-ED, and when the inducer is absent, the DBD-IP1 and ED-IP2 do not form a complex.

In some embodiments of any of the aspects, the two polypeptides of the induced proximity synTF are linked by a self-cleaving peptide (SCP), such that the synTF system is expressed by one vector and the two polypeptides are cleaved from each following translation. Accordingly, the induced proximity synTF system can comprise from N-terminus to C-terminus: DBD-IP1-SCP-ED-IP2; DBD-IP1-SCP-IP2-ED; IP1-DBD-SCP-ED-IP2; or IP1-DBD-SCP-IP2-ED In some embodiments of any of the aspects, the DBD of the induced proximity synTF comprises ZF1-3. In some

TABLE 19

Exemplary Pairs of $1^{st}$ and $2^{nd}$ IPD/SMASh synTF systems, with each polypeptide shown from N-terminus to C-terminus.

| 1st | 2nd | 1st | 2nd | 1st | 2nd |
| --- | --- | --- | --- | --- | --- |
| DBD-IP1 | ED-IP2 | SMASh-DBD-IP1 | ED-IP2 | DBD-IP1-SMASh | ED-IP2 |
|  | IP2-ED |  | IP2-ED |  | IP2-ED |
|  | SMASh-ED-IP2 |  | SMASh-ED-IP2 |  | SMASh-ED-IP2 |
|  | SMASh-IP2-ED |  | SMASh-IP2-ED |  | SMASh-IP2-ED |
|  | ED-IP2-SMASh |  | ED-IP2-SMASh |  | ED-IP2-SMASh |
|  | IP2-ED-SMASh |  | IP2-ED-SMASh |  | IP2-ED-SMASh |
| IP1-DBD | ED-IP2 | SMASh-IP1-DBD | ED-IP2 | IP1-DBD-SMASh | ED-IP2 |
|  | IP2-ED |  | IP2-ED |  | IP2-ED |
|  | SMASh-ED-IP2 |  | SMASh-ED-IP2 |  | SMASh-ED-IP2 |
|  | SMASh-IP2-ED |  | SMASh-IP2-ED |  | SMASh-IP2-ED |
|  | ED-IP2-SMASh |  | ED-IP2-SMASh |  | ED-IP2-SMASh |
|  | IP2-ED-SMASh |  | IP2-ED-SMASh |  | IP2-ED-SMASh |

In some embodiments, the sequence of each domain is selected from exemplary domain sequences as described herein. In some embodiments, the ED of the IPD/SMASh synTF system is a transcriptional activator. In some embodiments, the ED of the IPD/SMASh synTF system is a transcriptional repressor. When an inducer of the induced proximity pair is present, the IP1 and IP2 bind to the inducer resulting in formation of a protein complex comprising both polypeptides of the IPD/SMASh system, and when the inducer is absent, the polypeptides of the IPD/SMASh system do not form a complex. When an inducer of the induced degradation pair is present (e.g., a protease inhibitor), the IPD/SMASh synTF system is degraded. When an inducer of the induced degradation pair is absent (e.g., a protease inhibitor), the SMASh tag is degraded and the IPD/SMASh synTF system is not degraded.

C. Induced Proximity Domain SynTF

In some embodiments of any of the aspects, the regulator protein is a pair of induced proximity domains. Each of two members of the induced proximity pair is directly linked to the DBD or ED. Accordingly, in one aspect described herein is a synTF system comprising: (a) first polypeptide comprising: (i) a DBD and (ii) a first member of an induced proximity pair (IP1); and (b) a second polypeptide comprisembodiments of any of the aspects, the DBD of the induced proximity synTF comprises SEQ ID NO: 1 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the SEQ ID NO: 1, that maintains the same function.

In some embodiments of any of the aspects, the effector domain (ED) comprises a transcriptional activator. In one aspect, described herein is an induced proximity synTF, wherein: (a) the first polypeptide comprises from N-terminus to C-terminus: (i) a first member of an induced proximity pair and (ii) DBD; and (b) the second polypeptide comprises from N-terminus to C-terminus: (i) a transcriptional activator domain and (ii) a second member of an induced proximity pair. In some embodiments of any of the aspects, the first and second induced proximity synTFs are linked by a self-cleaving peptide. In some embodiments of any of the aspects, the induced proximity synTF comprises SEQ ID NOs: 4 or 40 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 4 or 40, that maintains the same function.

In some embodiments of any of the aspects, the induced proximity synTF is encoded by a vector or polynucleotide comprising SEQ ID NOs: 16 or 28 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 16 or 28, that maintains the same function of the encoded polypeptide, or a codon-optimized version of SEQ ID NOs: 16 or 28.

In some embodiments of any of the aspects, the effector domain (ED) comprises a transcriptional repressor. In one aspect, described herein is an induced proximity synTF, wherein: (a) the first polypeptide comprises from N-terminus to C-terminus: (i) a first member of an induced proximity pair and (ii) DBD; and (b) the second polypeptide comprises from N-terminus to C-terminus: (i) a transcriptional repressor domain and (ii) a second member of an induced proximity pair. In some embodiments of any of the aspects, the first and second induced proximity synTFs are linked by a self-cleaving peptide. In some embodiments of any of the aspects, the induced proximity synTF comprises SEQ ID NOs: 5 or 41 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 5 or 41, that maintains the same function.

In some embodiments of any of the aspects, the induced proximity synTF is encoded by a vector or polynucleotide comprising SEQ ID NOs: 17 or 29 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 17 or 29, that maintains the same function of the encoded polypeptide, or a codon-optimized version of SEQ ID NOs: 17 or 29.

D. Cytosolic Sequestering Domain SynTF

In some embodiments of any of the aspects, the regulator protein is a cytosolic sequestering protein. Accordingly, in one aspect described herein is a synTF comprising: (a) a DBD; (b) an ED; and (c) a cytosolic sequestering protein (CS). In some embodiments of any of the aspects, the domains of the synTF can be in order, e.g., from N-terminus to C-terminus: DBD-ED-CS; DBD-CS-ED; ED-DBD-CS; ED-CS-DBD; CS-DBD-ED; or CS-ED-DBD.

In some embodiments of any of the aspects, the DBD of the cytosolic sequestering synTF comprises ZF3-5. In some embodiments of any of the aspects, the DBD of the cytosolic sequestering synTF comprises SEQ ID NO: 2 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the SEQ ID NO: 2, that maintains the same function.

In some embodiments of any of the aspects, the effector domain (ED) comprises a transcriptional activator. In one aspect, described herein is a cytosolic sequestering synTF comprising from N-terminus to C-terminus: (a) DBD, (b) a transcriptional activator domain, and (c) a cytosolic sequestering domain. In some embodiments of any of the aspects, the cytosolic sequestering synTF comprises SEQ ID NOs: 6 or 42 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 6 or 42, that maintains the same function.

In some embodiments of any of the aspects, the cytosolic sequestering synTF is encoded by a vector or polynucleotide comprising SEQ ID NOs: 18 or 30 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 18 or 30, that maintains the same function of the encoded polypeptide, or a codon-optimized version of SEQ ID NOs: 18 or 30.

In some embodiments of any of the aspects, the effector domain (ED) comprises a transcriptional repressor. In one aspect, described herein is a cytosolic sequestering synTF comprising from N-terminus to C-terminus: (a) a transcriptional repressor domain, (b) a DBD, and (c) a cytosolic sequestering domain. In some embodiments of any of the aspects, the cytosolic sequestering synTF comprises SEQ ID NOs: 7, 43, or 378 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 7, 43, or 378, that maintains the same function.

In some embodiments of any of the aspects, the cytosolic sequestering synTF is encoded by a vector or polynucleotide comprising SEQ ID NOs: 19 or 31 or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 19 or 31, that maintains the same function of the encoded polypeptide, or a codon-optimized version of SEQ ID NOs: 19 or 31.

III. Polynucleotides and Vectors

In multiple aspects, described herein are polynucleotides that encode for synTFs. In some embodiments of any of the aspects, a synTF polynucleotide comprises one of SEQ ID NOs: 28-39 (see e.g., Table 2), or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 28-39, that as a polypeptide maintains the same function (e.g., inducible transcription factor).

In some embodiments, the synTF polynucleotide is a codon-optimized version of SEQ ID NOs: 28-39. In some embodiments of any of the aspects, the vector or nucleic acid described herein is codon-optimized, e.g., the native or wild-type sequence of the nucleic acid sequence has been altered or engineered to include alternative codons such that altered or engineered nucleic acid encodes the same polypeptide expression product as the native/wild-type sequence, but will be transcribed and/or translated at an improved efficiency in a desired expression system. In some embodiments of any of the aspects, the expression system is an organism other than the source of the native/wild-type sequence (or a cell obtained from such organism). In some embodiments of any of the aspects, the vector and/or nucleic acid sequence described herein is codon-optimized for expression in a mammal or mammalian cell, e.g., a mouse, a murine cell, or a human cell. In some embodiments of any of the aspects, the vector and/or nucleic acid sequence described herein is codon-optimized for expression in a human cell. In some embodiments of any of the aspects, the vector and/or nucleic acid sequence described herein is codon-optimized for expression in a yeast or yeast cell. In some embodiments of any of the aspects, the vector and/or nucleic acid sequence described herein is codon-optimized for expression in a bacterial cell. In some embodiments of any of the aspects, the vector and/or nucleic acid sequence described herein is codon-optimized for expression in an *E. coli* cell.

In some embodiments, one or more of the genes described herein (e.g., synTF, gene of interest) is expressed in a recombinant expression vector or plasmid. As used herein, the term "vector" refers to a polynucleotide sequence suitable for transferring transgenes into a host cell. The term "vector" includes plasmids, mini-chromosomes, phage, naked DNA and the like. See, for example, U.S. Pat. Nos. 4,980,285; 5,631,150; 5,707,828; 5,759,828; 5,888,783 and, 5,919,670, and, Sambrook et al, Molecular Cloning: A Laboratory Manual, 2nd Ed., Cold Spring Harbor Press (1989). One type of vector is a "plasmid," which refers to a circular double stranded DNA loop into which additional DNA segments are ligated. Another type of vector is a viral vector, wherein additional DNA segments are ligated into the viral genome. Certain vectors are capable of autonomous replication in a host cell into which they are introduced (e.g., bacterial vectors having a bacterial origin of replication and episomal mammalian vectors). Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" is used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

A cloning vector is one which is able to replicate autonomously or integrated in the genome in a host cell, and which is further characterized by one or more endonuclease restriction sites at which the vector may be cut in a determinable fashion and into which a desired DNA sequence can be ligated such that the new recombinant vector retains its ability to replicate in the host cell. In the case of plasmids, replication of the desired sequence can occur many times as the plasmid increases in copy number within the host cell such as a host bacterium or just a single time per host before the host reproduces by mitosis. In the case of phage, replication can occur actively during a lytic phase or passively during a lysogenic phase.

An expression vector is one into which a desired DNA sequence can be inserted by restriction and ligation such that it is operably joined to regulatory sequences, comprising DNA-binding domains as described herein, and can be expressed as an RNA transcript. Vectors can further contain one or more marker sequences suitable for use in the identification of cells which have or have not been transformed or transformed or transfected with the vector. Markers include, for example, genes encoding proteins which increase or decrease either resistance or sensitivity to antibiotics or other compounds, genes which encode enzymes whose activities are detectable by standard assays known in the art (e.g., β-galactosidase, luciferase or alkaline phosphatase), and genes which visibly affect the phenotype of transformed or transfected cells, hosts, colonies or plaques (e.g., green fluorescent protein). In certain embodiments, the vectors used herein are capable of autonomous replication and expression of the structural gene products present in the DNA segments to which they are operably joined.

As used herein, a coding sequence and regulatory sequences are said to be "operably" joined when they are covalently linked in such a way as to place the expression or transcription of the coding sequence under the influence or control of the regulatory sequences. If it is desired that the coding sequences be translated into a functional protein, two DNA sequences are said to be operably joined if induction of a promoter in the 5' regulatory sequences results in the transcription of the coding sequence and if the nature of the linkage between the two DNA sequences does not (1) result in the introduction of a frame-shift mutation, (2) interfere with the ability of the promoter region to direct the transcription of the coding sequences, or (3) interfere with the ability of the corresponding RNA transcript to be translated into a protein. Thus, a promoter region would be operably joined to a coding sequence if the promoter region were capable of effecting transcription of that DNA sequence such that the resulting transcript can be translated into the desired protein or polypeptide.

When the nucleic acid molecule that encodes any of the polypeptides described herein is expressed in a cell, a variety of transcription control sequences (e.g., promoter/enhancer sequences) can be used to direct its expression. The promoter can be a native promoter, i.e., the promoter of the gene in its endogenous context, which provides normal regulation of expression of the gene. In some embodiments the promoter can be constitutive, i.e., the promoter is unregulated allowing for continual transcription of its associated gene. A variety of conditional promoters also can be used, such as promoters controlled by the presence or absence of a molecule.

The precise nature of the regulatory sequences needed for gene expression can vary between species or cell types, but in general can include, as necessary, 5' non-transcribed and 5' non-translated sequences involved with the initiation of transcription and translation respectively, such as a TATA box, capping sequence, CAAT sequence, and the like. In particular, such 5' non-transcribed regulatory sequences will include a promoter region which includes a promoter sequence for transcriptional control of the operably joined gene. Regulatory sequences can also include enhancer sequences or upstream activator sequences as desired. The vectors of the invention may optionally include 5' leader or signal sequences. The choice and design of an appropriate vector is within the ability and discretion of one of ordinary skill in the art.

In some embodiments of any of the aspects, the promoter is a eukaryotic or human constitutive promoter, including but not limited to: a human elongation factor-1 alpha (EF-1alpha, EF1a) promoter; a silencing-prone spleen focus forming virus (SFFV); cytomegalovirus (CMV) promoter; a ubiquitin C (UbiC, pUb, UbC) promoter; phosphoglycerate kinase 1 (PGK, pGK) promoter; cytomegalovirus (CMV) enhancer fused to the chicken beta-actin promoter (CAG/CAGG); Simian virus 40 (SV40) enhancer and early promoter; beta actin (ACTB) promoter; and the like. In some embodiments of any of the aspects, the promoter is a minimal promoter or a core promoter. The minimal or core promoter, by definition, is the sequence located between the −35 to +35 region with respect to transcription start site; the minimal promoter is typically shorter than full promoters, and does not comprise additional elements such as enhancers or silencers. Non-limiting examples of minimal promoters include minCMV; CMV53 (minCMV with the addition of an upstream GC box); minSV40 (minimal simian virus 40 promoter); miniTK (the −33 to +32 region of the Herpes simplex thymidine kinase promoter); MLP (the −38 to +6 region of the adenovirus major late promoter); pJB42CAT5 (a minimal promoter derived from the human junB gene); ybTATA (a synthetic minimal promoter), and the TATA box alone. See e.g., Ede et al., ACS Synth Biol. 2016 May 20, 5(5): 395-404; Qin et al., PLoS One. 2010, 5(5): e10611; Norman et al., PLoS One. 2010 Aug. 26, 5(8):e12413; the contents of each of which are incorporated herein by reference in their entireties.

In some embodiments of any of the aspects, the vector (e.g., SEQ ID NOs: 16-27, 58-60, 64) comprises a SFFV promoter (e.g., SEQ ID NO: 363). In some embodiments of any of the aspects, the vector (e.g., SEQ ID NOs: 55-57) comprises a full CMV promoter (e.g., SEQ ID NO: 364). In some embodiments of any of the aspects, the vector (e.g., SEQ ID NOs: 52-54, 62) comprises a minCMV promoter (e.g., SEQ ID NO: 365). In some embodiments of any of the aspects, the vector (e.g., SEQ ID NOs: 61, 63, 64) comprises a minTK promoter (e.g., SEQ ID NO: 366). In some embodiments of any of the aspects, the vector comprises a Kozak sequence (e.g., GCCGCCACC), which is a nucleic acid motif that functions as the protein translation initiation site in eukaryotic mRNA transcripts.

Expression vectors containing all the necessary elements for expression are commercially available and known to those skilled in the art. See, e.g., Sambrook et al., *Molecular Cloning: A Laboratory Manual*, Second Edition, Cold Spring Harbor Laboratory Press, 1989. Cells are genetically engineered by the introduction into the cells of heterologous DNA (RNA). That heterologous DNA (RNA) is placed under operable control of transcriptional elements to permit the expression of the heterologous DNA in the host cell.

In some embodiments of any of the aspects, a synTF vector comprises one of SEQ ID NOs: 16-27 or SEQ ID NOs: 52-64 (see e.g., Tables 1 or 2) or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 236-261, that maintains the same functions as one of SEQ ID NOs: 16-27 or SEQ ID NOs: 52-64 (e.g., lentivirus vector, synTF polypeptide expression).

In some embodiments, the vector is a pHR vector. In some embodiments, the vector is a lentiviral vector. The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses. The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

In some embodiments of any of the aspects, the lentiviral vector comprises a central polypurine tract (cPPT; e.g., SEQ ID NO: 367). A central polypurine tract/central termination sequence creates a "DNA flap" that increases nuclear importation of the viral genome during target-cell infection. The cPPT/CTS element improves vector integration and transduction efficiency. In some embodiments of any of the aspects, the lentiviral vector comprises a woodchuck hepatitis virus posttranscriptional regulatory element (WPRE; e.g., SEQ ID NO: 368), which prevents poly(A) site readthrough, promotes RNA processing and maturation, and increases nuclear export of RNA. In genomic transcripts, it enhances vector packaging and increases titer. In transduced target cells, the WPRE boosts transgene expression by facilitating mRNA transcript maturation. In some embodiments of any of the aspects, the lentiviral vector comprises long terminal repeats (LTRs; e.g., SEQ ID NO: 369 and 370). LTRs are identical sequences of DNA that repeat hundreds or thousands of times found at either end of retrotransposons or proviral DNA formed by reverse transcription of retroviral RNA; they are used by viruses to insert their genetic material into the host genomes. In some embodiments of any of the aspects, the lentiviral vector comprises Rev response elements (RRE; e.g., SEQ ID NO: 371), which is required for producing high titer vectors.

Without limitations, the genes described herein can be included in one vector or separate vectors. For example, a polynucleotide encoding a synTF and a polynucleotide encoding a gene of interest can be included in the same vector. In some embodiments of any of the aspects, a polynucleotide encoding a synTF and a polynucleotide encoding a gene of interest can be included in different vectors. In some embodiments of any of the aspects, a single vector can comprise at least one polynucleotide encoding a synTF. In some embodiments of any of the aspects, a single vector can comprise at least one polynucleotide encoding a gene of interest. In some embodiments of any of the aspects, a single vector can comprise at least one polynucleotide encoding a synTF and at least one polynucleotide encoding a gene of interest.

In one aspect, described herein are synTF lentiviral expression vectors (e.g., SEQ ID NO: 16-27). In some embodiments, the synTF lentiviral expression vector comprises a polynucleotide encoding a synTF that is operably linked to a promoter (e.g., SFFV). In another aspect, described herein are lentiviral reporter vectors (e.g., SEQ ID NOs: 52-60). In some embodiments, the lentiviral reporter vector comprises: (i) at least one (e.g., 1, 2, 3, 4, or more) DNA-binding motif (DBM) for the DBD of a synTF; (ii) a promoter sequence located 3' of the at least one DBM; and (iii) a detectable marker (i.e., a reporter; e.g., mCherry) that is operably linked to the promoter sequence. In some embodiments, the lentiviral reporter vector is an activation reporter (e.g., SEQ ID NO: 52-54) for a synTF comprising a transcriptional activation domain, such that when the inducible synTF is ON, the DBD of the synTF binds to the DBM of the reporter and, the transcriptional activation domain activates transcription of the detectable marker; when the DBD of the inducible synTF is OFF and not bound to the DBM of the reporter, the detectable marker is not produced as it is operably linked to only a core or minimal promoter (e.g., minCMV). In some embodiments, the lentiviral reporter vector is a repression reporter (e.g., SEQ ID NO: 55-60) for an inducible synTF comprising a transcriptional repressor domain, such that when the synTF is ON, the DBD of the synTF binds to the DBM of the reporter, and the transcriptional repressor domain represses transcription of the detectable marker; when the synTF is OFF, the DBD of the synTF is not bound to the DBM of the reporter, and the detectable marker is produced as it is operably linked to a full, constitutive promoter (e.g., full CMV or SFFV).

In one aspect, described herein are gene of interest (GOI) lentiviral expression vectors (e.g., 61-64). In some embodiments, the GOI vector comprises a gene of interest that is operably linked to at least one (e.g., 1, 2, 3, 4, or more) DNA-binding motif (DBM) for the DBD of a synTF and a minimal promoter. In some embodiments, the GOI vector comprises a reporter vector as described herein, wherein the detectable marker is replaced with or fused to a gene of interest; as such the synTF can induce the expression of the gene of interest, or can repress the expression of a gene of interest, in the presence or absence of the regulator protein inducer.

In some embodiments, the polypeptide encoded by the gene of interest is selected from the group consisting of: a chemokine, a chemokine receptor, a chimeric antigen receptor, a cytokine, a cytokine receptor, a differentiation factor, a growth factor, a growth factor receptor, a hormone, a metabolic enzyme, a pathogen derived protein, a proliferation inducer, a receptor, a RNA guided nuclease, a site-specific nuclease, a small molecule 2nd messenger synthesis enzyme, a T cell receptor, a toxin derived protein, a transcription activator, a transcription repressor, a transcriptional activator, a transcriptional repressor, a translation regulator, a translational activator, a translational repressor, an activating immunoreceptor, an antibody, an apoptosis inhibitor, an apoptosis inducer, an engineered T cell receptor, an immunoactivator, an immunoinhibitor, an inhibiting immunoreceptor, and an RNA guided DNA binding protein. In some embodiments, the polypeptide encoded by the gene of interest would benefit a subject in need of treatment, e.g., a subject with cancer, autoimmutity, or need of regenerative medicine.

In some embodiments, the polypeptide encoded by the gene of interest is a CD19 CAR (e.g., SEQ ID NOs: 61, 373), e.g., linked to a detectable marker such as mCherry (e.g., SEQ ID NO: 372). In some embodiments, the polypeptide encoded by the gene of interest is IL2 (e.g., SEQ ID NOs: 62, 374), which can be linked to a detectable marker, e.g., (huEGFRt), using a self-cleaving peptide. In some embodiments, the polypeptide encoded by the gene of interest is IL10 (e.g., SEQ ID NOs: 63-64, 375).

In one aspect described herein is a lentiviral vector that comprises both a synTF operably linked to a constitutive promoter and a gene of interest operably linked to at least one (e.g., 1, 2, 3, 4, or more) DNA-binding motif (DBM) for the DBD of a synTF and a minimal promoter (e.g., SEQ ID NO: 64). Accordingly, described herein is a nucleic acid construct comprising in the 5' to 3' direction: (a) a nucleic acid sequence encoding a gene of interest (GOI) in the inverse orientation; (b) a first promoter sequence in the inverse orientation and operatively linked to the nucleic acid encoding the GOI; (c) a nucleic acid sequence comprising at least one target DNA binding motif (DBM) comprising a target nucleic acid for binding of the at least one DBD of a synTF, wherein binding of the DBD of the synTF places the effector domain (ED) in the proximity of the promoter sequence operatively linked to the GOI; (d) a second promoter sequence; and (e) a nucleic acid sequence encoding the synthetic transcription factor (synTF), operatively linked to the second promoter sequence, wherein the encoded synTF comprises at least one DBD that binds to the at least DBM of the nucleic acid sequence of (c).

In some embodiments of any of the aspects, the promoter sequence operatively linked to the GOI is selected from any of: miniCMV promoter, miniTK promoter, ybTATA promoter, minSV40 promoter, CMV53 promoter, pJB42CAT5 promoter, MLP promoter, and TATA promoter. In some embodiments of any of the aspects, wherein the promoter sequence operatively linked to the nucleic acid encoding the synTF is a pSFFV promoter, CMV promoter, pUb/UbC promoter, EF1a promoter, PGK/pGK promoter, CAG/CAGG promoter, SV40 promoter, and beta actin/ACTB promoter.

In some embodiments, the polynucleotide encoding the synTF is operatively linked to an inducible promoter, which is active in the presence of the promoter activator or the absence of the promoter repressor, and inactive in the absence of the promoter inducer or the presence of the promoter repressor. Non-limiting examples of inducible promoters include: a doxycycline-inducible promoter, the lac promoter, the lacUV5 promoter, the tac promoter, the trc promoter, the T5 promoter, the T7 promoter, the T7-lac promoter, the araBAD promoter, the rha promoter, the tet promoter, an isopropyl β-D-1-thiogalactopyranoside (IPTG)-dependent promoter, an AlcA promoter, a LexA promoter, a temperature inducible promoter (e.g., Hsp70 or Hsp90-derived promoters), or a light inducible promoter (e.g., pDawn/YFI/FixK2 promoter/CI/pR promoter system).

In some embodiments, the vector comprises a selectable marker, e.g., for selectively amplifying the vector in bacteria. Non-limiting examples of selectable marker genes for use in bacteria include antibiotic resistance genes conferring resistance to ampicillin, tetracycline and kanamycin. The tetracycline (tet) and ampicillin (amp) resistance marker genes can be obtained from any of a number of commercially available vectors including pBR322 (available from New England BioLabs, Beverly, Mass., cat. no. 303-3s). The tet coding sequence is contained within nucleotides 86-476; the amp gene is contained within nucleotides 3295-4155. The nucleotide sequence of the kanamycin (kan) gene is available from vector pACYC 177, from New England BioLabs, Cat no. 401-L, GenBank accession No. X06402.

In some embodiments, one or more of the recombinantly expressed genes can be integrated into the genome of the cell.

A nucleic acid molecule that encodes the enzyme of the claimed invention can be introduced into a cell or cells using methods and techniques that are standard in the art. For example, nucleic acid molecules can be introduced by standard protocols such as transformation including chemical transformation and electroporation, transduction, particle bombardment, etc. Expressing the nucleic acid molecule encoding the enzymes of the claimed invention also may be accomplished by integrating the nucleic acid molecule into the genome.

IV. synTF Systems

Another aspect of the technology relates to synTF system for controlling gene expression of a gene of interest (GOI), where a system comprises a synTF described herein and a nucleic acid construct comprising the elements that the synTF binds to regulate gene expression. In one aspect described herein is a system for controlling gene expression, comprising: (a) at least one synthetic transcription factor (synTF) as described herein; and (b) at least one nucleic acid construct as described herein, e.g., a nucleic acid construct comprising: (i) at least one target DNA binding motif (DBM) comprising a target nucleic acid for binding of the at least one DBD of the synTF; (ii) a promoter sequence located 3' of the at least one DBM, and (iii) a gene of interest operatively linked to the promoter sequence.

Exemplary systems are shown in FIGS. 1B, 2, 5C, 10B, 11A, 12A, 13A, 14A, and 15A-15B showing the synTF and the nucleic acid sequence construct comprising the gene of interest (e.g., mCherry, CD19 CAR, IL4, IL10). In synTF embodiments where the synTF is a protease synTF or induced proximity domain synTF, (i.e., where the coupling of the ED to the DBD is regulated by the at least one protease RP or at least one induced proximity pair), in the presence of the RP inducer, the coupling of the ED to the DBD of the synTF is maintained, such that when the DBD binds to the DNA binding motif (DBM) it enables the ED to be in proximity to the promoter sequence and promotes initiation or inhibition of gene expression of the gene of interest ("ED-on"). Alternatively, in the absence of the RP inducer, the coupling of the ED to the DBD of the synTF is severed, preventing the ED from being in proximity to the promoter sequence when the DBD binds to the DNA binding motif (DBM), preventing the ED from regulating the expression of the gene of interest ("ED-off"). Depending on whether the effector domain is a transcriptional activator (TA) or a transcriptional repressor (TR), the ED-on and ED-off will have differing effects—that is, if the ED is a TA, when the synTF is in the "ED-on" configuration, gene expression can occur, whereas if the ED is a transcriptional repressor (TR), the ED-on configuration will result in repression of gene expression (e.g., no expression). Conversely, if the ED is a TA, when the synTF is in the "ED-off" configuration, gene expression is OFF, whereas if the ED is a transcriptional repressor (TR), the "ED-off" configuration will depress the repression of gene expression, so gene expression is ON. A summary of the effect of each regulator promoter inducer on the ultimate gene expression depending on the different synTF and the effector domain is summarized in Table 20 herein.

Similarly, and by way of example only, in a synTF embodiment where the synTF is a cytosolic sequestering domain synTF, (i.e., where the cellular localization of the ED-DBD fusion protein is regulated by the at least one cytosolic sequestering regulator protein), in the presence of the RP inducer, the ED-DBD is not sequestered in the cytosol, enabling the DBD to bind to the DNA binding motif (DBM) and placing the transcriptional effector domain (ED) to be in proximity to the promoter sequence to control the expression of the gene of interest ("ED-on"). Accordingly, in the presence of the inducer, if the ED is a TA the ED-on configuration will enable gene expression to occur (referred to as "TA-on"), whereas if the ED is a TR, the ED-on configuration will result in repression of gene expression (e.g., referred to as "TR-on" and no gene expression). Alternatively, in the absence of the RP inducer, the ED coupled to the DBD of the synTF is sequestered in the cytosol, preventing the DBD of the synTF from binding to the DBM, and preventing the effector domain (ED) from being in proximity to the promoter sequence, preventing expression of the gene of interest ("ED-off"). Accordingly, in the absence of the inducer, in embodiments where the ED is a transcriptional activator (TA), it results in turning off the gene expression ("TA-off" (no expression)), whereas in embodiments where the ED is a transcriptional repressor protein (TR), it turns on gene expression ("TR-off", therefore repression is off, therefore enabling gene expression to occur).

In some embodiments of any of the aspect described herein, the synTF is an induced degradation domain synTF or further comprises a N-terminal or C-terminal Small molecule-Assisted Shutoff (SMASh) domain. As described herein, the SMASh domain comprises a self-cleaving SMASh protease, a partial protease helical domain and a cofactor domain. In some embodiments of any of the aspects, in the presence of an inhibitor to the SMASh protease (referred to as a "SMASh inhibitor"), the SMASh protease activity is inhibited resulting in the synTF being degraded, which prevents the DBD binding to the DBM and controlling the expression or repression of the gene of interest ("synTF-degradation"; ED-off). In some embodiments of any of the aspects, in the absence of an inhibitor to the SMASh protease, the SMASh protease is active and self cleaves/uncouples from the synTF, resulting the SMASh domain being targeted for degradation and allowing the DBD of the synTF to bind to the DBM and the ED of synTF to control the expression of the gene of interest ("SMASh-degradation, TA-on (yes-expression), TR-on (no-expression)).

TABLE 20A

Table summarizing the effect of the presence or absence of regulator protein inducers on the ultimate expression of the gene of interest.

| SynTF | Presence or absence of RP inducer → effect on the SynTF → effect on binding to the DBM | Effector domain → ED on/off | Gene expression ON or OFF |
|---|---|---|---|
| Protease domain synTF | Present → DBD-ED is coupled→ "ED-On" | TA → "TA-on" | ON |
| | | RP → "RP-on" | OFF |
| | Absent → DBD-ED is uncoupled → ED-Off | TA → "TA-off" | OFF |
| | | RP → "RP-off" | ON |
| Induced proximity domain synTF | Present → DBD-ED is coupled → ED-On | TA → "TA-on" | ON |
| | | RP → "RP-on" | OFF |
| | Absent → DBD-ED is uncoupled → ED-Off | TA → "TA-off" | OFF |
| | | RP → "RP-off" | ON |
| Translocation domain synTF | Present → SynTF translocates to nucleus (sequestering is inhibited) → ED-On | TA → "TA-on" | ON |
| | | RP → "RP-on" | OFF |
| | Absent → SynTF is sequestered in cytosol → ED-Off | TA → "TA-off" | OFF |
| | | RP → "RP-off" | ON |
| Induced degradation domain synTF | Present → SynTF-degradation → ED-Off | TA → "TA-off" | OFF |
| | | RP → "RP-off" | ON |
| | Absent → SMASh degradation, ED available → ED-On | TA → "TA-on" | ON |
| | | RP → "RP-on" | OFF |

Accordingly, the expression of the GOI is dependent on 3 levels of control, including but not limited to; (i) the type of regulator protein in the synTF, (ii) the presence or absence of a regulator protein inducer (RP inducer), and (iii) the type of effector domain. In some embodiments, if the synTF comprises an induced degradation domain or SMASh domain, it can also provide an additional level of control on the expression of the GOI. The ultimate expression of the GOI of synTF comprising a SMASh domain are shown in Table 20B.

DBD binds to the DNA binding motif (DBM), where the ED controls the expression of the gene of interest ("ED-on"), or in the absence of the RP inducer, the coupling of the ED to the DBD of the synTF is severed, preventing the ED from being in proximity to the promoter sequence when the DBD

TABLE 20B

| SynTF | SMASh inhibitor | Effect of SMASh inhibitor | Regulator Protein inducer | Effect of RP inducer | Effector domain | Gene expression |
|---|---|---|---|---|---|---|
| Protease domain synTF: PD-SynTF:SMASh | Present | SynTF degradation (ED-OFF) | n/a n/a | n/a n/a | TA (TA-off) TR (TA-off) | OFF ON |
| | Absent | SMASh degradation | Protease inhibitor Present | "ED on" (DBD-ED coupled) | TA (TA-on) TR (TR-on) | ON OFF |
| | | | Protease inhibitor Absent | "ED off" (DBD and ED uncoupled) | TA (TA-off) TR (TR-off) | OFF ON |
| Induced proximity domain synTF: IPD-SynTF:SMASh | Present | SynTF degradation (ED-OFF) | n/a n/a | n/a n/a | TA (TA-off) TR (TA-off) | OFF ON |
| | Absent | SMASh degradation | IPD inducer Present | "ED on" (DBD-ED coupled) | TA (TA-on) TR (TR-on) | ON OFF |
| | | | IPD inducer Absent | "ED off" (DBD and ED uncoupled) | TA (TA-off) TR (TR-off) | OFF ON |
| Cytosolic sequestering: CS-synTF:SMASh | Present | SynTF degradation (ED-OFF) | n/a n/a | n/a n/a | TA (TA-off) TR (TA-off) | OFF ON |
| | Absent | SMASh degradation | Cytosolic sequestering ligand Present | "ED on" (CS-synTF translocates to nucleus (sequestering is inhibited)) | TA (TA-on) TR (TR-on) | ON OFF |
| | | | Cytosolic sequestering ligand Absent | "ED off" (CS-SynTF sequestered in cytosol) | TA (TA-off) TR (TR-off) | OFF ON |

As indicated in Table 20B, if the SMASh inhibitor is present, then even in the absence or presence of the regulator protein inducer (e.g., protease inhibitor, IPD inducer agent or ligand for CS-SynTF), the synTF is degraded and the expression of the GOI depends on whether the ED is a TA or TR. However, in the absence of the SMASh inhibitor, the expression of the GOI is dependent on the presence or absence of the regulator protein inducer, as shown in Table 20B.

Accordingly, in one aspect, described herein is a system for controlling gene expression, comprising: (a) at least one synthetic transcription factor (synTF) comprising at least one DNA binding domain (DBD), a transcriptional effector domain (ED), and at least one regulator protein (RP), wherein the ED is directly or indirectly coupled or linked to the DBD, and wherein the coupling is regulated by the at least one RP, or wherein the cellular localization of the ED linked to the DBD is regulated by the at least one RP, wherein the at least one RP is regulated by an RP inducer, wherein the DBD can bind to a target DNA binding motif (DBM) located upstream of a promoter operatively linked to a gene; (b) a nucleic acid construct comprising: (i) at least one target DNA binding motif (DBM) comprising a target nucleic acid for binding of the at least one DBD of the synTF, and (ii) a promoter sequence located 3' of the at least one DBM, and (iii) a gene of interest operatively linked to the promoter sequence; wherein for synTFs where the coupling of the ED to the DBD is regulated by the at least one RP; in the presence of the RP inducer, the coupling of the ED to the DBD of the synTF is maintained, enabling the ED to be in proximity to the promoter sequence when the binds to the DNA binding motif (DBM), preventing gene expression of the gene of interest ("ED-off"); and wherein for synTFs where the cellular localization of the ED linked to the DBD is regulated by the at least one regulator protein; in the presence of the RP inducer, the ED coupled to the DBD of the synTF is not sequestered in the cytosol, enabling the DBD to bind to the DNA binding motif (DBM) and enabling the transcriptional effector domain (ED) to be in proximity to the promoter sequence to control the expression of the gene of interest ("ED-on"), or in the absence of the RP inducer, the ED coupled to the DBD of the synTF is sequestered in the cytosol, preventing the DBD of the synTF from binding to the DBM, and preventing the effector domain (ED) from being in proximity to the promoter sequence, preventing expression of the gene of interest ("ED-off").

Nucleic Acid Constructs Encoding the GOI for Regulation by the synTF

Figure 5A:
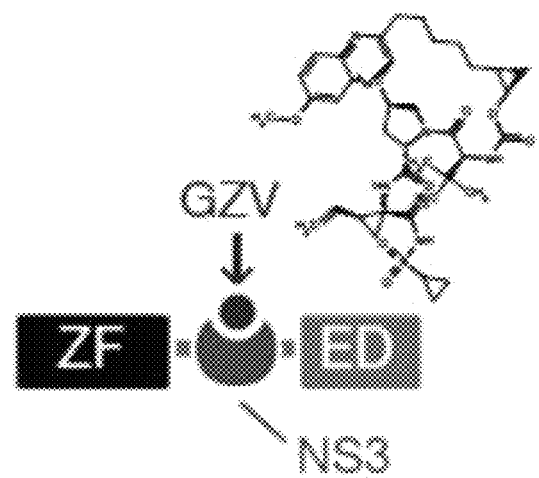
FIG. 5A-5C is a series of schematics showing an exemplary synTF regulated by self-cleaving protease inhibition.
Figure 5B:
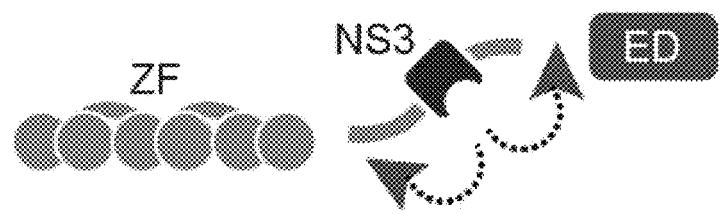
Figure 5C:
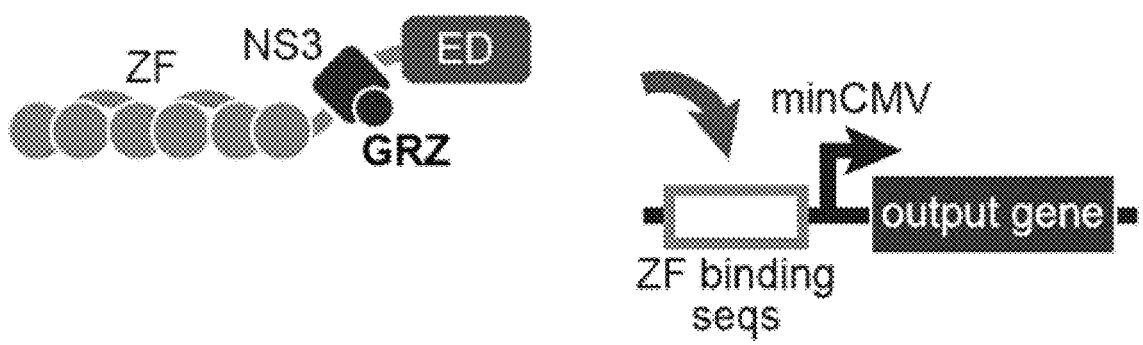
Figure 12A:
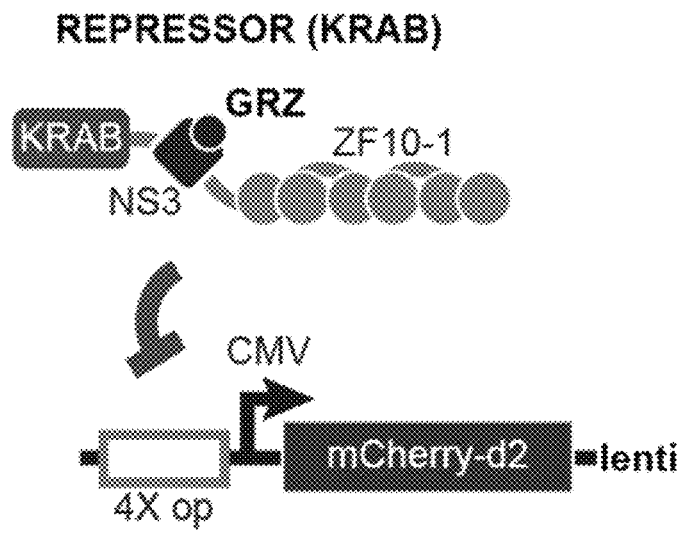
FIG. 12A-12C is a series of schematics and graphs showing inducible synthetic transcriptional repression of a fluorescent protein in human cell lines.

As described herein, in some aspects, the system comprises a synTF as described herein and a nucleic acid construct comprising the GOI. In some embodiments, the nucleic acid construct comprises in the 5' to 3' direction, (i) a DBA binding motif (DBM) that enables binding of the DBD of the synTF, (ii) a promoter sequence, and (iii) a nucleic acid encoding the GOI, where the nucleic acid encoding the GOI is operatively linked to the promoter sequence. An exemplary system is shown in FIGS. 5C and 12A.

In some embodiments, the system further comprises a nucleic acid sequence encoding the synTF, operatively linked to a promoter, for example, where the promoter is a constitutive promoter, see, e.g. FIGS. 10B, 13A, 14A and 15A for exemplary systems. In such an embodiment, when the inducer to the promoter is present, the synTF can be expressed, and the activity of the synTF on controlling gene expression of the GOI is dependent on the presence or absence of the regulator protein inducer and/or SMASh inducer if a SMASh domain is attached.

In some embodiments, the nucleic acid construct comprises (i) a first nucleic acid encoding the synTF under a promoter and (ii) a second nucleic acid construct comprising (i) a DBA binding motif (DBM) that enables binding of the DBD of the expressed synTF, (ii) a promoter sequence, and (iii) a nucleic acid encoding the GOI, where the nucleic acid encoding the GOI is operatively linked to the promoter sequence. Accordingly, the nucleic acid encoding the inducible synTF and the GOI are present on the same nucleic acid construct, see, for example, FIG. 15B for such an exemplary system.

Figure 15A:
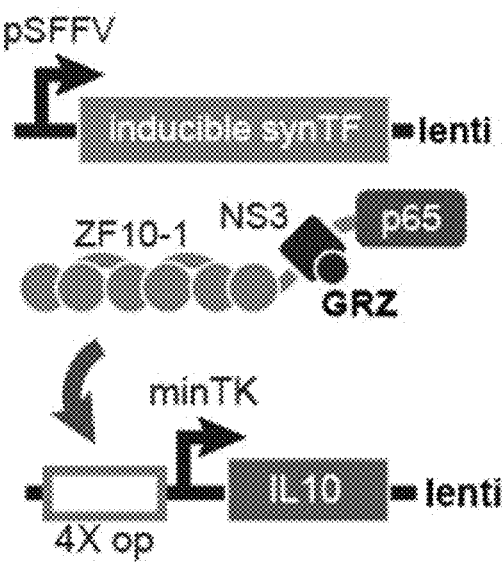
FIG. 15A-15C is a series of schematics showing nucleic acid constructs for a system for controlling gene expression and graphs showing that administration of a small molecule (grazoprevir) led to temporal activation of a cytokine (IL10) from a ZF-responsive promoter in Jurkat T cell lines.
Figure 15B:
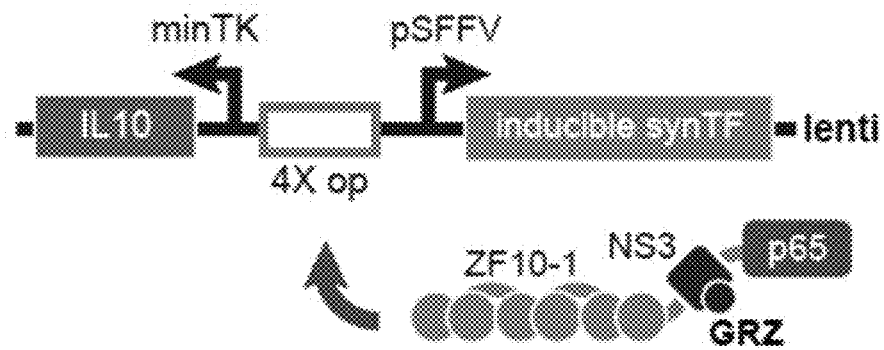

In some embodiments, the nucleic acid construct comprises (i) a first promoter operatively linked to a nucleic acid encoding the synTF, and (ii) a nucleic acid encoding a GOI, operatively linked to a second promoter, where 5' to the second promoter is the DBM for the synTF protein which is expressed under control of the first promoter. In some embodiments, as shown in FIG. 15B, the construct comprises the following in a 5' to 3' orientation: (i) a nucleic acid encoding a GOI in the antisense orientation, (ii) a first promoter in the antisense orientation which is operatively linked to the GOI, (iii) a DBD in the antisense orientation, (iv) a second promoter in the sense orientation, and (v) a nucleic acid encoding a synTF in the sense orientation which is operatively linked to the second promoter. Such a system allows the expression of the synTF, where the expressed synTF can be used to regulate the expression of the GOI in the presence or absence of inducers for the synTF.

In some embodiments of any of the aspects, the promoter which is operatively linked to the GOI or to the synTF is selected from any of: miniCMV promoter, miniTK promoter, ybTATA promoter, minSV40 promoter, CMV53 promoter, pJB42CAT5 promoter, MLP promoter, TATA promoter, pSFFV promoter, CMV promoter, pUb/UbC promoter, EF1a promoter, PGK/pGK promoter, CAG/CAGG promoter, SV40 promoter, and beta actin/ACTB promoter.

Figure 14A:
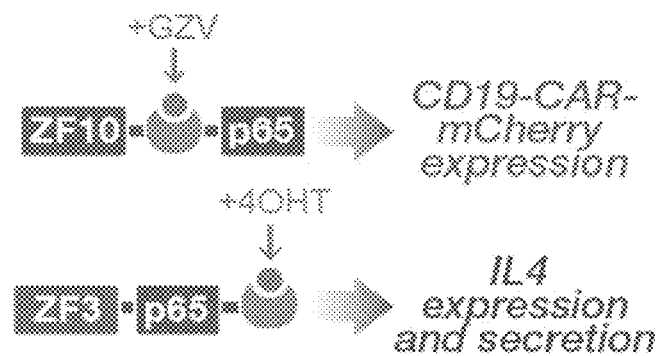
FIG. 14A-14B is a series of schematics and graphs showing the control of CD19 CAR and IL-4 expression in primary human T cells.
Figure 14B:
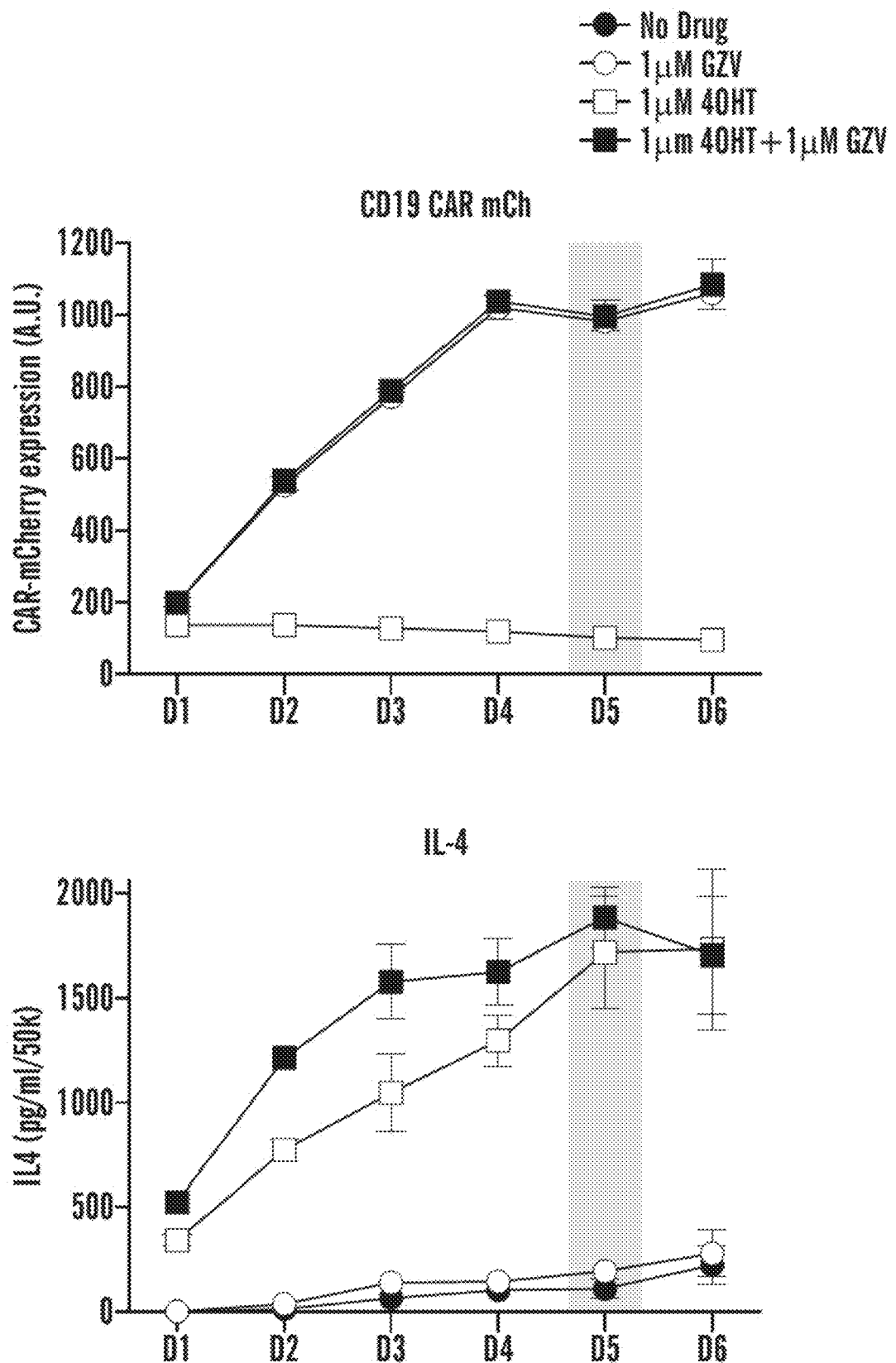
Figure 14C:
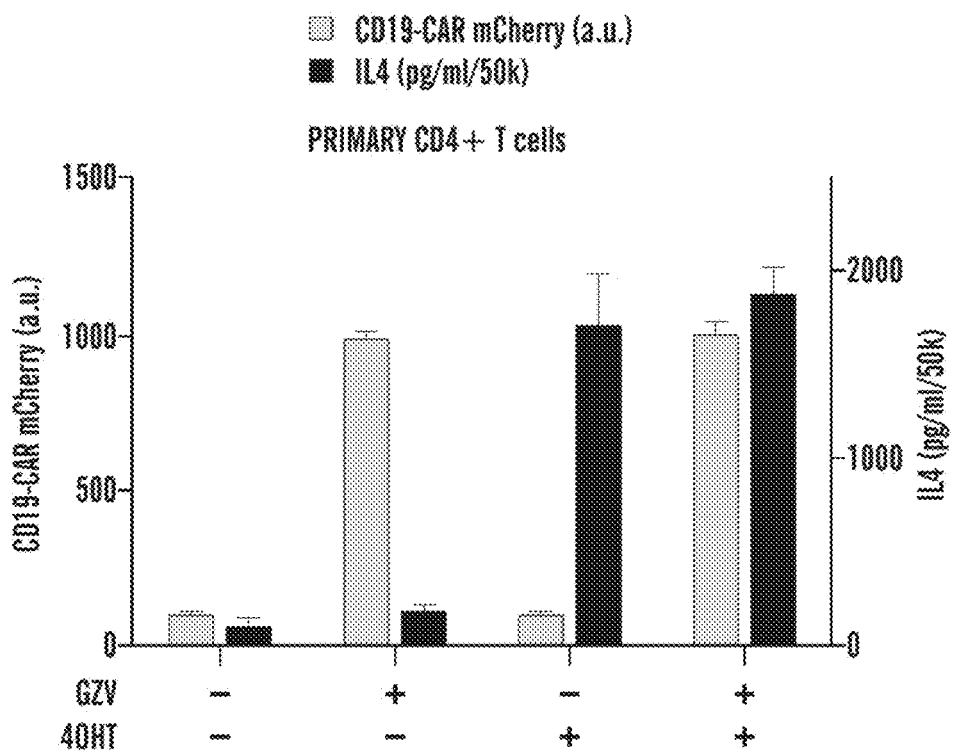
FIG. 14C is a bar graph showing CD19-CAR expression (light grey, left axis) and IL-4 expression (dark grey, right axis) in the presence or absence of GZV or 4OHT, as indicated, at day 5.

In some embodiments of any of the aspects, the at least one synTF expressed by the system is selected from any of those described herein. In some embodiments of any of the aspects, a synTF system can comprise any combination of at least two synTF polypeptides as described herein, controlling the same or different GOIs. As a non-limiting example, FIG. 14A-14C shows a system comprising two synTFs each with a separate regulator protein and GOI: a repressible protease synTF that controls CD19 CAR expression and a cytosolic sequestering domain synTF that controls IL4 expression. Table 9 below shows non-limiting examples of such synTF system combinations. In some embodiments of any of the aspects, the examples shown in Table 9 can be in combination with a regulator protein inducer (e.g., a small molecule drug such as grazoprevir, ABA, 4OHT).

TABLE 9

| synTF systems. | | | | | | | |
|---|---|---|---|---|---|---|---|
| PRO | ID | IPD | CS | PRO | ID | IPD | CS |
| X | | | | X | | | X |
| | X | | | | X | X | |

TABLE 9-continued

| synTF systems. | | | | | | | |
|---|---|---|---|---|---|---|---|
| PRO | ID | IPD | CS | PRO | ID | IPD | CS |
| | X | | | | X | | X |
| | | | X | | | X | X |
| X | X | | | X | X | X | |
| X | | X | | X | X | | X |
| X | | X | X | X | X | X | X |
| | X | X | X | | | | |

"PRO" indicates the repressible protease synTF polypeptides and systems as described herein.
"ID" indicates the induced degradation synTF polypeptides and systems as described herein.
"IPD" indicates the induced proximity synTF polypeptides and systems as described herein.
"CS" indicates the cytosolic sequestering domain synTF polypeptides and systems as described herein.

V. Cells

In one aspect, described herein is a cell or population thereof comprising the at least one synTF polypeptide, synTF system, synTF polynucleotide, or synTF vector as described herein (see e.g., Tables 1-2). In some embodiments of any of the aspects, the cell or population thereof can comprise any combination of synTF polypeptides or systems (see e.g., Table 9).

In one aspect, the invention provides a cell (e.g., T cell) engineered to express a synTF, wherein the activity of the synTF cell can be controlled by a small molecule. In one aspect a cell is transformed with the synTF, and the synTF is expressed on the cell surface. In some embodiments, the cell (e.g., T cell) is transduced with a viral vector encoding a synTF. In some embodiments, the viral vector is a retroviral vector. In some embodiments, the viral vector is a lentiviral vector. In some such embodiments, the cell may stably express the synTF. In another embodiment, the cell (e.g., T cell) is transfected with a nucleic acid, e.g., mRNA, cDNA, DNA, encoding a synTF. In some such embodiments, the cell may transiently express the synTF.

In one aspect described herein is a cell comprising: a nucleic acid sequence comprising at least one target DNA binding motif (DBM) comprising a target nucleic acid for binding of the at least one DBD of a synTF, a promoter sequence located 3' of the at least one DBM, and a nucleic acid encoding a gene of interest (GOI) operatively linked to the promoter sequence.

In one aspect described herein is a cell comprising: (a) a first nucleic acid sequence comprising at least one target DNA binding motif (DBM) comprising a target nucleic acid for binding of the at least one DBD of a synTF, a promoter sequence located 3' of the at least one DBM, and a nucleic acid encoding a gene of interest (GOI) operatively linked to the promoter sequence, and (b) a second nucleic acid sequence comprising a nucleic acid encoding a synthetic transcription factor (synTF) as described herein, operatively linked to an inducible or constitutive promoter.

In some embodiments of any of the aspects, the cell comprises a nucleic acid construct comprising in the 5' to 3' direction: (a) a nucleic acid sequence encoding a gene of interest (GOI) in the inverse orientation; (b) a first promoter sequence in the inverse orientation and operatively linked to the nucleic acid encoding the GOI; (c) a nucleic acid sequence comprising at least one target DNA binding motif (DBM) comprising a target nucleic acid for binding of the at least one DBD of a synTF, wherein binding of the DBD of the synTF places the effector domain (ED) in the proximity of the promoter sequence operatively linked to the GOI; (d) a second promoter sequence; and (e) a nucleic acid sequence encoding the synthetic transcription factor (synTF), operatively linked to the second promoter sequence, wherein the encoded synTF comprises at least one DBD that binds to the at least DBM of the nucleic acid sequence of (c).

In some embodiments of any of the aspects, the promoter sequence operatively linked to the GOI is selected from any of: miniCMV promoter, miniTK promoter, ybTATA promoter, minSV40 promoter, CMV53 promoter, pJB42CAT5 promoter, MLP promoter, and TATA promoter. In some embodiments of any of the aspects, wherein the promoter sequence operatively linked to the nucleic acid encoding the synTF is a pSFFV promoter, CMV promoter, pUb/UbC promoter, EF1a promoter, PGK/pGK promoter, CAG/CAGG promoter, SV40 promoter, and beta actin/ACTB promoter.

In some embodiments of any of the aspects, the cell comprises an immune cell. In some embodiments of any of the aspects, the immune cell comprises a CD4+ T cell, a CD8+ T cell, a regulatory T cell (Treg), or a natural killer (NK) cell. In one embodiment, the cell comprises a T cell. In one embodiment, the cell comprises a CD4+ T cell. In one embodiment, the cell comprises a CD8+ T cell. In other embodiments, the cell comprises a B cell.

In some embodiments of any of the aspects, the cells are isolated from a subject. The term "isolated" as used herein signifies that the cells are placed into conditions other than their natural environment. The term "isolated" does not preclude the later use of these cells thereafter in combinations or mixtures with other cells. In some embodiments of any of the aspects, an immune cell (e.g., T cell) is: (a) isolated from the subject; (b) genetically modified to express a synTF system as described herein; and (c) administered to the subject. In some embodiments of any of the aspects, the cells are isolated from a first subject and administered to a second subject. In some embodiments of any of the aspects, the immune cells are first differentiated from a somatic cell sample from the subject and then genetically modified to express a synTF system as described herein.

In some embodiments of any of the aspects, the cell comprises an inactivating modification of at least one HLA Class I gene in the cell. In some embodiments, an endogenous HLA (e.g., class I and/or class II major histocompatibility complexes) can be edited or removed, e.g., to reduce immunogenicity. In some embodiments, the genetic modification can comprise introduction and expression of non-canonical HLA-G and HLA-E to prevent NK cell-mediated lysis (see e.g., Riolobos L et al. 2013), which can provide a source of universal T cells for immunotherapy, e.g., cancer immune therapy.

In some embodiments, methods of genetically modifying a cell to express a synTF system can comprise but are not limited to: transfection or electroporation of a cell with a vector encoding a synTF; transduction with a viral vector (e.g., retrovirus, lentivirus) encoding a synTF system; gene editing using zinc finger nucleases (ZFNs), transcription activator-like effector nucleases (TALENs), meganuclease-TALENs, or CRISPR-Cas; or any other methods known in the art of genetically modifying a cell to express a synTF system.

VI. Pharmaceutical Compositions and Administration

In some embodiments, the methods described herein relate to treating a subject having or diagnosed as having a disease or disorder (e.g., cancer or autoimmunity) with a synTF system as described herein. Subjects having such a disease or disorder can be identified by a physician using current methods of diagnosis for cancer or autoimmunity. Symptoms and/or complications which characterize these conditions and aid in diagnosis are known in the art. A family history of cancer or autoimmunity, or exposure to risk factors for cancer or autoimmunity can also aid in determining if a subject is likely to have such a disease or disorder, or in making a diagnosis of cancer or autoimmunity.

The compositions described herein can be administered to a subject having or diagnosed as having cancer or autoimmunity. In some embodiments, the methods described herein comprise administering an effective amount of compositions described herein, e.g. a synTF system as described herein to a subject in order to alleviate a symptom of cancer or autoimmunity. As used herein, "alleviating a symptom" is ameliorating any condition or symptom associated with the cancer or autoimmunity. As compared with an equivalent untreated control, such reduction is by at least 5%, 10%, 20%, 40%, 50%, 60%, 80%, 90%, 95%, 99% or more as measured by any standard technique.

A variety of means for administering the compositions described herein to subjects are known to those of skill in the art. An agent can be administered intravenously by injection or by gradual infusion over time. Given an appropriate formulation for a given route, for example, agents useful in the methods and compositions described herein can be administered intravenously, intranasally, by inhalation, intraperitoneally, intramuscularly, subcutaneously, intracavity, intratumorally, and can be delivered by peristaltic means, if desired, or by other means known by those skilled in the art. In some embodiments of any of the aspects, the compounds used herein are administered orally, intravenously or intramuscularly. Administration can be local or systemic. Local administration, e.g., directly to the site of an organ or tissue transplant is specifically contemplated.

Therapeutic compositions containing at least one agent can be conventionally administered in a unit dose, for example. The term "unit dose" when used in reference to a therapeutic composition refers to physically discrete units suitable as unitary dosage for the subject, each unit containing a predetermined quantity of active material calculated to produce the desired therapeutic effect in association with the required physiologically acceptable diluent, i.e., carrier, or vehicle.

The compositions are administered in a manner compatible with the dosage formulation, and in a therapeutically effective amount. The quantity to be administered and timing depends on the subject to be treated, capacity of the subject's system to utilize the active ingredient, and degree of therapeutic effect desired.

In embodiments where the subject is administered a synTF cell and a regulator protein inducer to modulate the activity of the synTF polypeptide(s) (e.g., grazoprevir, ABA, 4OHT), the cells and drug(s) can be administered together or separately. In embodiments where the subject is separately administered a synTF cell and a drug to modulate the activity of the synTF polypeptide(s), each of the compositions can be administered, separately, according to any of the dosages and administration routes/routines described herein.

The term "effective amount" as used herein refers to the amount of a synTF system as described herein and/or a regulator protein inducer (e.g., grazoprevir, ABA, 4OHT) needed to alleviate at least one or more symptom of the disease or disorder, and relates to a sufficient amount of pharmacological composition to provide the desired effect. The term "therapeutically effective amount" therefore refers to an amount of a synTF system as described herein and/or a regulator protein inducer (e.g., grazoprevir, ABA, 4OHT) that is sufficient to provide a particular anti-tumor or anti-autoimmune effect when administered to a typical subject. An effective amount as used herein, in various contexts, would also include an amount sufficient to delay the development of a symptom of the disease, alter the course of a symptom disease (for example but not limited to, slowing the progression of a symptom of the disease), or reverse a symptom of the disease. Thus, it is not generally practicable to specify an exact "effective amount". However, for any given case, an appropriate "effective amount" can be determined by one of ordinary skill in the art using only routine experimentation.

Effective amounts, toxicity, and therapeutic efficacy can be determined by standard pharmaceutical procedures in cell cultures or experimental animals, e.g., for determining the LD50 (the dose lethal to 50% of the population) and the ED50 (the dose therapeutically effective in 50% of the population). The dosage can vary depending upon the dosage form employed and the route of administration utilized. The dose ratio between toxic and therapeutic effects is the therapeutic index and can be expressed as the ratio LD50/ED50. Compositions and methods that exhibit large therapeutic indices are preferred. A therapeutically effective dose can be estimated initially from cell culture assays. Also, a dose can be formulated in animal models to achieve a circulating plasma concentration range that includes the IC50 (i.e., the concentration of a synTF system as described herein and/or a regulator protein inducer (e.g., grazoprevir, ABA, 4OHT)), which achieves a half-maximal inhibition of symptoms) as determined in cell culture, or in an appropriate animal model. Levels in plasma can be measured, for example, by high performance liquid chromatography for the regulator protein inducer or flow cytometry for synTF cells. The effects of any particular dosage can be monitored by a suitable bioassay. The dosage can be determined by a physician and adjusted, as necessary, to suit observed effects of the treatment.

Effective amounts, toxicity, and therapeutic efficacy can be determined by standard pharmaceutical procedures in cell cultures or experimental animals, e.g., for determining the minimal effective dose and/or maximal tolerated dose. The dosage can vary depending upon the dosage form employed and the route of administration utilized. A therapeutically effective dose can be estimated initially from cell culture assays. Also, a dose can be formulated in animal models to achieve a dosage range between the minimal effective dose and the maximal tolerated dose. The effects of any particular dosage can be monitored by a suitable bioassay, e.g., assay for tumor growth and/or size among others. The dosage can be determined by a physician and adjusted, as necessary, to suit observed effects of the treatment.

It can generally be stated that a pharmaceutical composition comprising the synTF-system-expressing cells described herein may be administered at a dosage of $10^2$ to $10^{10}$ cells/kg body weight, preferably $10^5$ to $10^6$ cells/kg body weight, including all integer values within those ranges. The number of cells will depend upon the ultimate use for which the composition is intended as will the type of cells included therein. For uses provided herein, the cells are generally in a volume of a liter or less, can be 500 mLs or less, even 250 mLs or 100 mLs or less. Hence the density of the desired cells is typically greater than $10^6$ cells/ml and generally is greater than $10^7$ cells/ml, generally $10^8$ cells/ml or greater. The clinically relevant number of immune cells can be apportioned into multiple infusions that cumulatively equal or exceed $10^5$, $10^6$, $10^7$, $10^8$, $10^9$, $10^{10}$, $10^{11}$, or $10^{12}$ cells. SynTF-system-expressing cell compositions may be administered multiple times at dosages within these ranges. The cells may be allogeneic, syngeneic, xenogeneic, or autologous to the patient undergoing therapy. If desired, the treatment may also include administration of mitogens (e.g., PHA) or lymphokines, cytokines, and/or chemokines (e.g., IFN-γ, IL-2, IL-12, TNF-alpha, IL-18, and TNF-beta, GM-CSF, IL-4, IL-13, Flt3-L, RANTES, MIP1α, etc.) as described herein to enhance induction of the immune response. In some embodiments, the dosage can be from about $1\times10^5$ cells to about $1\times10^8$ cells per kg of body weight. In some embodiments, the dosage can be from about $1\times10^6$ cells to about $1\times10^7$ cells per kg of body weight. In some embodiments, the dosage can be about $1\times10^6$ cells per kg of body weight. In some embodiments, one dose of cells can be administered. In some embodiments, the dose of cells can be repeated, e.g., once, twice, or more. In some embodiments, the dose of cells can be administered on, e.g., a daily, weekly, or monthly basis.

In certain embodiments, an effective dose of a regulatory protein inducer (e.g., grazoprevir, ABA, 4OHT; also referred to herein as an inducer agent) that regulates the activity of a synTF as described herein can be administered to a patient once. In certain embodiments, an effective dose of a regulatory protein inducer can be administered to a patient repeatedly. In some embodiments of any of the aspects, the effective dose of ABA is about 1 mM. In some embodiments of any of the aspects, the effective dose of 4OHT is about 4 µM. In some embodiments of any of the aspects, the effective dose of grazoprevir is about 4 µM.

In some embodiments of any of the aspects, the effective dose of a regulatory protein inducer (e.g., grazoprevir) is at least 0.05 mM, at least 0.1 mM, at least 0.15 mM, at least 0.2 mM, at least 0.25 mM, at least 0.3 mM, at least 0.35 mM, at least 0.4 mM, at least 0.45 mM, at least 0.5 mM, at least 0.55 mM, at least 0.6 mM, at least 0.65 mM, at least 0.7 mM, at least 0.75 mM, at least 0.8 mM, at least 0.85 mM, at least 0.9 mM, at least 0.95 mM, at least 1 mM, at least 1.05 mM, at least 1.1 mM, at least 1.15 mM, at least 1.2 mM, at least 1.25 mM, at least 1.3 mM, at least 1.35 mM, at least 1.4 mM, at least 1.45 mM, at least 1.5 mM, at least 1.55 mM, at least 1.6 mM, at least 1.65 mM, at least 1.7 mM, at least 1.75 mM, at least 1.8 mM, at least 1.85 mM, at least 1.9 mM, at least 1.95 mM, at least 2 mM, at least 2.05 mM, at least 2.1 mM, at least 2.15 mM, at least 2.2 mM, at least 2.25 mM, at least 2.3 mM, at least 2.35 mM, at least 2.4 mM, at least 2.45 mM, at least 2.5 mM, at least 2.55 mM, at least 2.6 mM, at least 2.65 mM, at least 2.7 mM, at least 2.75 mM, at least 2.8 mM, at least 2.85 mM, at least 2.9 mM, at least 2.95 mM, at least 3 mM, at least 3.05 mM, at least 3.1 mM, at least 3.15 mM, at least 3.2 mM, at least 3.25 mM, at least 3.3 mM, at least 3.35 mM, at least 3.4 mM, at least 3.45 mM, at least 3.5 mM, at least 3.55 mM, at least 3.6 mM, at least 3.65 mM, at least 3.7 mM, at least 3.75 mM, at least 3.8 mM, at least 3.85 mM, at least 3.9 mM, at least 3.95 mM, at least 4 mM, at least 4.05 mM, at least 4.1 mM, at least 4.15 mM, at least 4.2 mM, at least 4.25 mM, at least 4.3 mM, at least 4.35 mM, at least 4.4 mM, at least 4.45 mM, at least 4.5 mM, at least 4.55 mM, at least 4.6 mM, at least 4.65 mM, at least 4.7 mM, at least 4.75 mM, at least 4.8 mM, at least 4.85 mM, at least 4.9 mM, at least 4.95 mM, or at least 5 mM.

In some embodiments of any of the aspects, the effective dose of a regulatory protein inducer (e.g., ABA, 4OHT) is at least 0.05 µM, at least 0.1 µM, at least 0.15 µM, at least 0.2

µM, at least 0.25 µM, at least 0.3 µM, at least 0.35 µM, at least 0.4 µM, at least 0.45 µM, at least 0.5 µM, at least 0.55 µM, at least 0.6 µM, at least 0.65 µM, at least 0.7 µM, at least 0.75 µM, at least 0.8 µM, at least 0.85 µM, at least 0.9 µM, at least 0.95 µM, at least 1 µM, at least 1.05 µM, at least 1.1 µM, at least 1.15 µM, at least 1.2 µM, at least 1.25 µM, at least 1.3 µM, at least 1.35 µM, at least 1.4 µM, at least 1.45 µM, at least 1.5 µM, at least 1.55 µM, at least 1.6 µM, at least 1.65 µM, at least 1.7 µM, at least 1.75 µM, at least 1.8 µM, at least 1.85 µM, at least 1.9 µM, at least 1.95 µM, at least 2 µM, at least 2.05 µM, at least 2.1 µM, at least 2.15 µM, at least 2.2 µM, at least 2.25 µM, at least 2.3 µM, at least 2.35 µM, at least 2.4 µM, at least 2.45 µM, at least 2.5 µM, at least 2.55 µM, at least 2.6 µM, at least 2.65 µM, at least 2.7 µM, at least 2.75 µM, at least 2.8 µM, at least 2.85 µM, at least 2.9 µM, at least 2.95 µM, at least 3 µM, at least 3.05 µM, at least 3.1 µM, at least 3.15 µM, at least 3.2 µM, at least 3.25 µM, at least 3.3 µM, at least 3.35 µM, at least 3.4 µM, at least 3.45 µM, at least 3.5 µM, at least 3.55 µM, at least 3.6 µM, at least 3.65 µM, at least 3.7 µM, at least 3.75 µM, at least 3.8 µM, at least 3.85 µM, at least 3.9 µM, at least 3.95 µM, at least 4 µM, at least 4.05 µM, at least 4.1 µM, at least 4.15 µM, at least 4.2 µM, at least 4.25 µM, at least 4.3 µM, at least 4.35 µM, at least 4.4 µM, at least 4.45 µM, at least 4.5 µM, at least 4.55 µM, at least 4.6 µM, at least 4.65 µM, at least 4.7 µM, at least 4.75 µM, at least 4.8 µM, at least 4.85 µM, at least 4.9 µM, at least 4.95 µM, or at least 5 µM.

For systemic administration, subjects can be administered a therapeutic amount of a regulatory protein inducer, such as, e.g. 0.1 mg/kg, 0.5 mg/kg, 1.0 mg/kg, 2.0 mg/kg, 2.5 mg/kg, 5 mg/kg, 10 mg/kg, 15 mg/kg, 20 mg/kg, 25 mg/kg, 30 mg/kg, 40 mg/kg, 50 mg/kg, or more.

In some embodiments, the dose can be from about 2 mg/kg to about 15 mg/kg. In some embodiments, the dose can be about 2 mg/kg. In some embodiments, the dose can be about 4 mg/kg. In some embodiments, the dose can be about 5 mg/kg. In some embodiments, the dose can be about 6 mg/kg. In some embodiments, the dose can be about 8 mg/kg. In some embodiments, the dose can be about 10 mg/kg. In some embodiments, the dose can be about 15 mg/kg. In some embodiments, the dose can be from about 100 mg/m$^2$ to about 700 mg/m$^2$. In some embodiments, the dose can be about 250 mg/m$^2$. In some embodiments, the dose can be about 375 mg/m$^2$. In some embodiments, the dose can be about 400 mg/m$^2$. In some embodiments, the dose can be about 500 mg/m$^2$.

In some embodiments, the dose can be administered intravenously. In some embodiments, the intravenous administration can be an infusion occurring over a period of from about 10 minute to about 3 hours. In some embodiments, the intravenous administration can be an infusion occurring over a period of from about 30 minutes to about 90 minutes.

In some embodiments the dose can be administered about weekly. In some embodiments, the dose can be administered weekly. In some embodiments, the dose can be administered weekly for from about 12 weeks to about 18 weeks. In some embodiments the dose can be administered about every 2 weeks. In some embodiments the dose can be administered about every 3 weeks. In some embodiments, the dose can be from about 2 mg/kg to about 15 mg/kg administered about every 2 weeks. In some embodiments, the dose can be from about 2 mg/kg to about 15 mg/kg administered about every 3 weeks. In some embodiments, the dose can be from about 2 mg/kg to about 15 mg/kg administered intravenously about every 2 weeks. In some embodiments, the dose can be from about 2 mg/kg to about 15 mg/kg administered intravenously about every 3 weeks. In some embodiments, the dose can be from about 200 mg/m2 to about 400 mg/m2 administered intravenously about every week. In some embodiments, the dose can be from about 200 mg/m2 to about 400 mg/m2 administered intravenously about every 2 weeks. In some embodiments, the dose can be from about 200 mg/m2 to about 400 mg/m2 administered intravenously about every 3 weeks. In some embodiments, a total of from about 2 to about 10 doses are administered. In some embodiments, a total of 4 doses are administered. In some embodiments, a total of 5 doses are administered. In some embodiments, a total of 6 doses are administered. In some embodiments, a total of 7 doses are administered. In some embodiments, a total of 8 doses are administered. In some embodiments, the administration occurs for a total of from about 4 weeks to about 12 weeks. In some embodiments, the administration occurs for a total of about 6 weeks. In some embodiments, the administration occurs for a total of about 8 weeks. In some embodiments, the administration occurs for a total of about 12 weeks. In some embodiments, the initial dose can be from about 1.5 to about 2.5 fold greater than subsequent doses.

In some embodiments, the dose can be from about 1 mg to about 2000 mg. In some embodiments, the dose can be about 3 mg. In some embodiments, the dose can be about 10 mg. In some embodiments, the dose can be about 30 mg. In some embodiments, the dose can be about 1000 mg. In some embodiments, the dose can be about 2000 mg. In some embodiments, the dose can be about 3 mg given by intravenous infusion daily. In some embodiments, the dose can be about 10 mg given by intravenous infusion daily. In some embodiments, the dose can be about 30 mg given by intravenous infusion three times per week.

In some embodiments, after an initial treatment regimen, the treatments can be administered on a less frequent basis. For example, after treatment biweekly for three months, treatment can be repeated once per month, for six months or a year or longer. Treatment according to the methods described herein can reduce levels of a marker or symptom of a condition, e.g. by at least 10%, at least 15%, at least 20%, at least 25%, at least 30%, at least 40%, at least 50%, at least 60%, at least 70%, at least 80% or at least 90% or more.

The dosage of a synTF cell and/or regulatory protein inducer as described herein can be determined by a physician and adjusted, as necessary, to suit observed effects of the treatment. With respect to duration and frequency of treatment, it is typical for skilled clinicians to monitor subjects in order to determine when the treatment is providing therapeutic benefit, and to determine whether to increase or decrease dosage, increase or decrease administration frequency, discontinue treatment, resume treatment, or make other alterations to the treatment regimen. The dosing schedule can vary from once a week to daily depending on a number of clinical factors, such as the subject's sensitivity to the synTF system and/or the regulatory protein inducer. The desired dose or amount can be administered at one time or divided into subdoses, e.g., 2-4 subdoses and administered over a period of time, e.g., at appropriate intervals through the day or other appropriate schedule. In some embodiments, administration can be chronic, e.g., one or more doses and/or treatments daily over a period of weeks or months. Examples of dosing and/or treatment schedules are administration daily, twice daily, three times daily or four or more times daily over a period of 1 week, 2 weeks, 3 weeks, 4 weeks, 1 month, 2 months, 3 months, 4 months, 5 months, or 6 months, or more. A composition comprising a synTF system as described herein can be administered over a period of time, such as over a 5 minute, 10 minute, 15 minute, 20 minute, or 25 minute period.

The dosage ranges for the administration of a synTF system, according to the methods described herein depend upon, for example, the form of the synTF system, its potency, and the extent to which symptoms, markers, or indicators of a condition described herein are desired to be reduced, for example the percentage reduction desired for the disease or disorder (e.g., cancer or autoimmunity). The dosage should not be so large as to cause adverse side effects. Generally, the dosage will vary with the age, condition, and sex of the patient and can be determined by one of skill in the art. The dosage can also be adjusted by the individual physician in the event of any complication.

The efficacy of a synTF system in, e.g. the treatment of a condition described herein can be determined by the skilled clinician. However, a treatment is considered "effective treatment," as the term is used herein, if one or more of the signs or symptoms of a condition described herein are altered in a beneficial manner, other clinically accepted symptoms are improved, or even ameliorated, or a desired response is induced e.g., by at least 10% following treatment according to the methods described herein. Efficacy can be assessed, for example, by measuring a marker, indicator, symptom, and/or the incidence of a condition treated according to the methods described herein or any other measurable parameter appropriate, e.g. tumor size. Efficacy can also be measured by a failure of an individual to worsen as assessed by hospitalization, or need for medical interventions (i.e., progression of the disease is halted). Methods of measuring these indicators are known to those of skill in the art and/or are described herein. Treatment includes any treatment of a disease in an individual or an animal (some non-limiting examples include a human or an animal) and includes: (1) inhibiting the disease, e.g., preventing a worsening of symptoms (e.g. pain or inflammation); or (2) relieving the severity of the disease, e.g., causing regression of symptoms. An effective amount for the treatment of a disease means that amount which, when administered to a subject in need thereof, is sufficient to result in effective treatment as that term is defined herein, for that disease. Efficacy of an agent can be determined by assessing physical indicators of a condition or desired response, (e.g. tumor size). It is well within the ability of one skilled in the art to monitor efficacy of administration and/or treatment by measuring any one of such parameters, or any combination of parameters. Efficacy can be assessed in animal models of a condition described herein, for example treatment of cancer. When using an experimental animal model, efficacy of treatment is evidenced when a statistically significant change in a marker is observed, e.g. tumor size.

In vitro and animal model assays are provided herein which allow the assessment of a given dose of a synTF system. The efficacy of a given dosage combination can also be assessed in an animal model, e.g. a specific cancer animal model.

In one aspect, described herein is a pharmaceutical composition comprising the at least one synTF polypeptide, synTF system, synTF polynucleotide, synTF vector, or synTF-comprising cell as described herein, which are collectively referred to as a "synTF composition" (see e.g., Tables 1-2). In some embodiments of any of the aspects, the pharmaceutical composition can comprise any combination of synTF polypeptides or systems (see e.g., Table 9). In some embodiments of any of the aspects, the pharmaceutical composition can further comprise a regulator protein inducer (e.g., grazoprevir, ABA, 4OHT).

In some embodiments, the technology described herein relates to a pharmaceutical composition comprising a synTF composition and/or regulator protein inducer as described herein, and optionally a pharmaceutically acceptable carrier. In some embodiments, the active ingredients of the pharmaceutical composition comprise the synTF system and/or the regulator protein inducer as described herein. In some embodiments, the active ingredients of the pharmaceutical composition consist essentially of the synTF system and/or the regulator protein inducer as described herein. In some embodiments, the active ingredients of the pharmaceutical composition consist of the synTF system and/or the regulator protein inducer as described herein. Pharmaceutically acceptable carriers and diluents include saline, aqueous buffer solutions, solvents and/or dispersion media. The use of such carriers and diluents is well known in the art. Some non-limiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids; (23) serum component, such as serum albumin, HDL and LDL; (24) $C_2$-$C_{12}$ alcohols, such as ethanol; and (25) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein. In some embodiments, the carrier inhibits the degradation of the active agent, e.g. the synTF polypeptide, the synTF system, and/or the regulator protein inducer as described herein.

In some embodiments, the pharmaceutical composition comprising a synTF composition and/or a regulator protein inducer as described herein can be a parenteral dose form. Since administration of parenteral dosage forms typically bypasses the patient's natural defenses against contaminants, parenteral dosage forms are preferably sterile or capable of being sterilized prior to administration to a patient. Examples of parenteral dosage forms include, but are not limited to, solutions ready for injection, dry products ready to be dissolved or suspended in a pharmaceutically acceptable vehicle for injection, suspensions ready for injection, and emulsions. In addition, controlled-release parenteral dosage forms can be prepared for administration of a patient, including, but not limited to, DUROS®-type dosage forms and dose-dumping.

Suitable vehicles that can be used to provide parenteral dosage forms of synTF compositions and/or a regulator protein inducer as disclosed within are well known to those skilled in the art. Examples include, without limitation: sterile water; water for injection USP; saline solution; glucose solution; aqueous vehicles such as but not limited to, sodium chloride injection, Ringer's injection, dextrose Injection, dextrose and sodium chloride injection, and lactated Ringer's injection; water-miscible vehicles such as, but not limited to, ethyl alcohol, polyethylene glycol, and propylene glycol; and non-aqueous vehicles such as, but not limited to, corn oil, cottonseed oil, peanut oil, sesame oil, ethyl oleate, isopropyl myristate, and benzyl benzoate.

Pharmaceutical compositions comprising synTF compositions and/or a regulator protein inducer can also be formulated to be suitable for oral administration, for example as discrete dosage forms, such as, but not limited to, tablets (including without limitation scored or coated tablets), pills, caplets, capsules, chewable tablets, powder packets, cachets, troches, wafers, aerosol sprays, or liquids, such as but not limited to, syrups, elixirs, solutions or suspensions in an aqueous liquid, a non-aqueous liquid, an oil-in-water emulsion, or a water-in-oil emulsion. Such compositions contain a predetermined amount of the pharmaceutically acceptable salt of the disclosed compounds, and may be prepared by methods of pharmacy well known to those skilled in the art. See generally, Remington: The Science and Practice of Pharmacy, 21st Ed., Lippincott, Williams, and Wilkins, Philadelphia Pa. (2005).

Conventional dosage forms generally provide rapid or immediate drug release from the formulation. Depending on the pharmacology and pharmacokinetics of the drug, use of conventional dosage forms can lead to wide fluctuations in the concentrations of the drug in a patient's blood and other tissues. These fluctuations can impact a number of parameters, such as dose frequency, onset of action, duration of efficacy, maintenance of therapeutic blood levels, toxicity, side effects, and the like. Advantageously, controlled-release formulations can be used to control a drug's onset of action, duration of action, plasma levels within the therapeutic window, and peak blood levels. In particular, controlled- or extended-release dosage forms or formulations can be used to ensure that the maximum effectiveness of a drug is achieved while minimizing potential adverse effects and safety concerns, which can occur both from under-dosing a drug (i.e., going below the minimum therapeutic levels) as well as exceeding the toxicity level for the drug. In some embodiments, the composition can be administered in a sustained release formulation.

Controlled-release pharmaceutical products have a common goal of improving drug therapy over that achieved by their non-controlled release counterparts. Ideally, the use of an optimally designed controlled-release preparation in medical treatment is characterized by a minimum of drug substance being employed to cure or control the condition in a minimum amount of time. Advantages of controlled-release formulations include: 1) extended activity of the drug; 2) reduced dosage frequency; 3) increased patient compliance; 4) usage of less total drug; 5) reduction in local or systemic side effects; 6) minimization of drug accumulation; 7) reduction in blood level fluctuations; 8) improvement in efficacy of treatment; 9) reduction of potentiation or loss of drug activity; and 10) improvement in speed of control of diseases or conditions. Kim, Cherng-ju, Controlled Release Dosage Form Design, 2 (Technomic Publishing, Lancaster, Pa.: 2000).

Most controlled-release formulations are designed to initially release an amount of drug (active ingredient) that promptly produces the desired therapeutic effect, and gradually and continually release other amounts of drug to maintain this level of therapeutic or prophylactic effect over an extended period of time. In order to maintain this constant level of drug in the body, the drug must be released from the dosage form at a rate that will replace the amount of drug being metabolized and excreted from the body. Controlled-release of an active ingredient can be stimulated by various conditions including, but not limited to, pH, ionic strength, osmotic pressure, temperature, enzymes, water, and other physiological conditions or compounds.

A variety of known controlled- or extended-release dosage forms, formulations, and devices can be adapted for use with the salts and compositions of the disclosure. Examples include, but are not limited to, those described in U.S. Pat. Nos. 3,845,770; 3,916,899; 3,536,809; 3,598,123; 4,008,719; 5,674,533; 5,059,595; 5,591,767; 5,120,548; 5,073,543; 5,639,476; 5,354,556; 5,733,566; and 6,365,185 B1; each of which is incorporated herein by reference. These dosage forms can be used to provide slow or controlled-release of one or more active ingredients using, for example, hydroxypropylmethyl cellulose, other polymer matrices, gels, permeable membranes, osmotic systems (such as OROS® (Alza Corporation, Mountain View, Calif. USA)), or a combination thereof to provide the desired release profile in varying proportions.

In some embodiments of any of the aspects, the synTF composition and/or regulator protein inducer described herein is administered as a monotherapy, e.g., another treatment for the disease or disorder (e.g., cancer) is not administered to the subject.

In some embodiments of any of the aspects, the methods described herein can further comprise administering a second agent and/or treatment to the subject, e.g. as part of a combinatorial therapy. Non-limiting examples of a second agent and/or treatment can include radiation therapy, surgery, gemcitabine, cisplatin, paclitaxel, carboplatin, bortezomib, AMG479, vorinostat, rituximab, temozolomide, rapamycin, ABT-737, PI-103; alkylating agents such as thiotepa and CYTOXAN® cyclophosphamide; alkyl sulfonates such as busulfan, improsulfan and piposulfan; aziridines such as benzodopa, carboquone, meturedopa, and uredopa; ethylenimines and methylmelamines including altretamine, triethylenemelamine, trietylenephosphoramide, triethylenethiophosphoramide and trimethylol melamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, fotemustine, lomustine, nimustine, and ranimustine; antibiotics such as the enediyne antibiotics (e.g., calicheamicin, especially calicheamicin gamma1I and calicheamicin omega1I (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomycins, actinomycin, authramycin, azaserine, bleomycins, cactinomycin, carabicin, caminomycin, carzinophilin, chromomycins, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE® Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylornithine (DMFO); retinoids such as retinoic acid; capecitabine; combretastatin; leucovorin (LV); oxaliplatin, including the oxaliplatin treatment regimen (FOLFOX); lapatinib (Tykerb®); inhibitors of PKC-alpha, Raf, H-Ras, EGFR (e.g., erlotinib (Tarceva®)) and VEGF-A that reduce cell proliferation and pharmaceutically acceptable salts, acids or derivatives of any of the above.

In addition, the methods of treatment can further include the use of radiation or radiation therapy. Further, the methods of treatment can further include the use of surgical treatments.

VII. Treatment Methods

The synTF compositions described herein can be administered to a subject in need thereof, in particular the treatment of cancer or autoimmunity. Autoimmunity is the system of immune responses of an organism against its own healthy cells and tissues. Any disease that results from such an aberrant immune response is termed an "autoimmune disease". In some embodiments of any of the aspects, the subject has a genetic disorder in need of regenerative medicine and/or immunotherapy.

In some embodiments, the synTF system expresses a gene of interest (e.g., a therapeutic protein, analyte), which is controlled by at least one inducible synTF, that is itself regulated by at least one regulator protein and its corresponding regulator protein inducer. As such, the expression of the gene of interest can be specifically regulated by the presence, absence, or increased or decreased level of the regulator protein inducer (e.g., an FDA-approved small molecule such as grazoprevir, ABA, or 4OHT) for the treatment of a disease such as cancer, autoimmunity, or a genetic disorder.

Figure 15C:
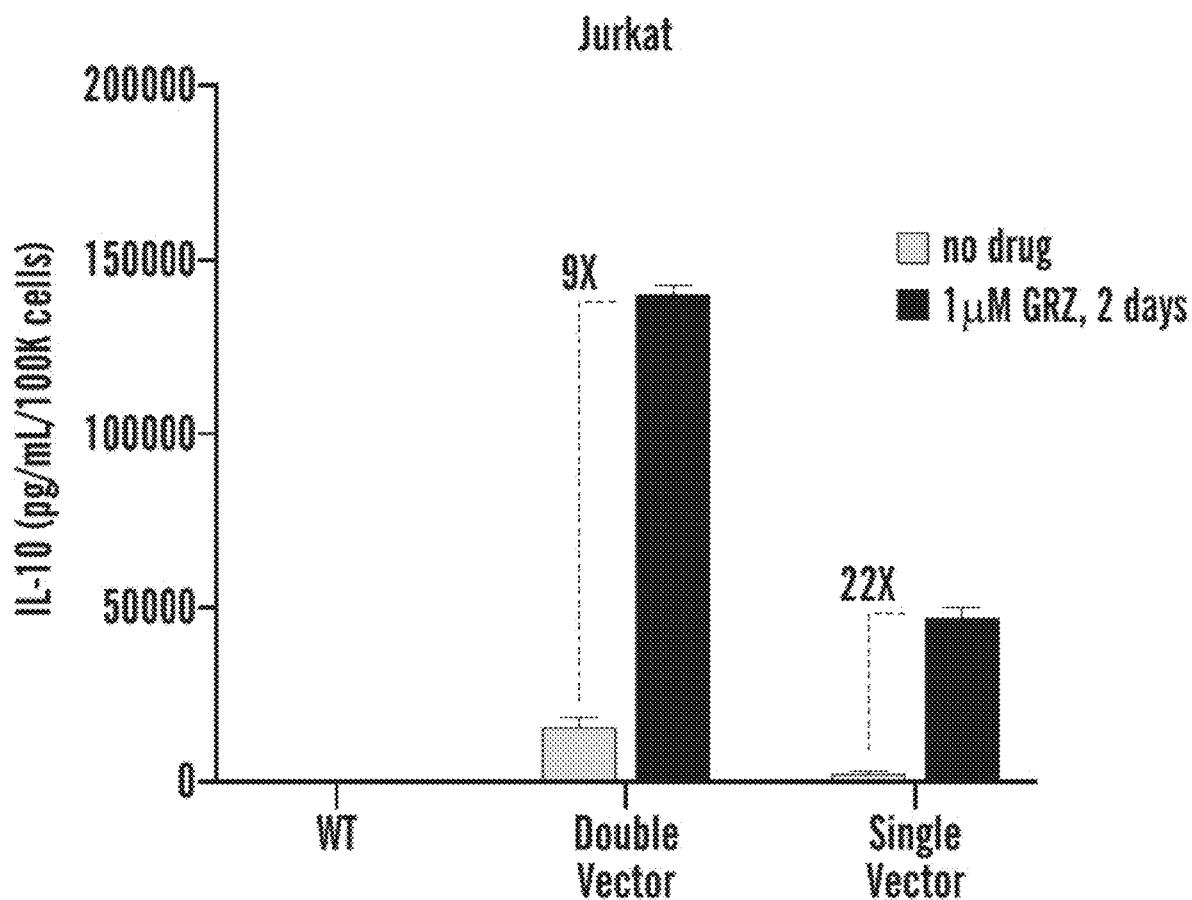

By way of example only, FIG. 13A-13D shows an exemplary system to treat cancer where CD19-CAR is regulated by a repressible protease synTF. As another non-limiting example, FIG. 14A-14C shows an exemplary system to treat cancer where CD19-CAR and IL4 are regulated by a repressible protease synTF and a cytosolic sequestering synTF, respectively. As another non-limiting example, FIG. 15A-15C shows an exemplary system to treat autoimmune disease where IL10 is regulated by a repressible protease synTF, which can be expressed from a single vector system or a double vector system.

In some embodiments, the method of treatment can comprise first diagnosing a subject or patient who can benefit from treatment by a composition described herein. In some embodiments, such diagnosis comprises detecting or measuring an abnormal level of a marker (e.g., the tumor antigens as described herein) in a sample from the subject or patient. In some embodiments, the method further comprises administering to the patient a synTF composition as described herein.

In some embodiments, the subject has previously been determined to have an abnormal level of an analyte described herein relative to a reference. In some embodiments, the reference level can be the level in a sample of similar cell type, sample type, sample processing, and/or obtained from a subject of similar age, sex and other demographic parameters as the sample/subject. In some embodiments, the test sample and control reference sample are of the same type, that is, obtained from the same biological source, and comprising the same composition, e.g. the same number and type of cells.

The term "sample" or "test sample" as used herein denotes a sample taken or isolated from a biological organism, e.g., a blood or plasma sample from a subject. In some embodiments of any of the aspects, the technology described herein encompasses several examples of a biological sample. In some embodiments of any of the aspects, the biological sample is cells, or tissue, or peripheral blood, or bodily fluid. Exemplary biological samples include, but are not limited to, a biopsy, a tumor sample, biofluid sample; blood; serum; plasma; urine; sperm; mucus; tissue biopsy; organ biopsy; synovial fluid; bile fluid; cerebrospinal fluid; mucosal secretion; effusion; sweat; saliva; and/or tissue sample etc. The term also includes a mixture of the above-mentioned samples. The term "test sample" also includes untreated or pretreated (or pre-processed) biological samples. In some embodiments of any of the aspects, a test sample can comprise cells from a subject.

In some embodiments of any of the aspects, the step of determining if the subject has an abnormal level of an analyte described herein can comprise i) obtaining or having obtained a sample from the subject and ii) performing or having performed an assay on the sample obtained from the subject to determine/measure the level of the analyte in the subject. In some embodiments of any of the aspects, the step of determining if the subject has an abnormal level of an analyte described herein can comprise performing or having performed an assay on a sample obtained from the subject to determine/measure the level of analyte in the subject. In some embodiments of any of the aspects, the step of determining if the subject has an abnormal level of an analyte described herein can comprise ordering or requesting an assay on a sample obtained from the subject to determine/measure the level of the analyte in the subject. In some embodiments of any of the aspects, the step of determining if the subject has an abnormal level of an analyte described herein can comprise receiving the results of an assay on a sample obtained from the subject to determine/measure the level of the analyte in the subject. In some embodiments of any of the aspects, the step of determining if the subject has an abnormal level of an analyte described herein can comprise receiving a report, results, or other means of identifying the subject as a subject with a decreased level of the analyte.

In one aspect of any of the embodiments, described herein is a method of treating cancer (or another disease or disorder as described herein) in a subject in need thereof, the method comprising: a) determining if the subject has an abnormal level of an analyte described herein; and b) instructing or directing that the subject be administered a synTF composition as described herein if the level of the analyte is increased or otherwise abnormal relative to a reference. In some embodiments of any of the aspects, the step of instructing or directing that the subject be administered a particular treatment can comprise providing a report of the assay results. In some embodiments of any of the aspects, the step of instructing or directing that the subject be administered a particular treatment can comprise providing a report of the assay results and/or treatment recommendations in view of the assay results.

In one aspect, described herein is a method of regulating the activity of a synTF, comprising the steps of: (a) providing a population of cells comprising a synTF as described herein; and (b) contacting the population of cells with an effective amount of a regulator protein inducer.

In one aspect, described herein is a method of regulating the expression of a gene of interest, comprising the steps of: (a) providing a population of cells comprising a synTF system as described herein; and (b) contacting the population of cells with an effective amount of a regulator protein inducer.

In one aspect, described herein is a method of treating a subject in need of a cell-based therapy. In some embodiments of any of the aspects, a subject in need of a cell-based therapy comprises any subject that would benefit from regulated expression of a gene of interest. In some embodiments of any of the aspects, a subject in need of a cell-based therapy comprises a subject with cancer, autoimmunity, or another disease or disorder as described herein. In some embodiments of any of the aspects, the subject has a genetic disorder in need of regenerative medicine and/or immunotherapy. Accordingly, the method comprises the steps of: (a) administering to the subject a population of cells comprising a synTF system as described herein; and (b) administering to the subject an effective amount of a regulator protein inducer.

In embodiments wherein the synTF comprises a transcriptional activator and a repressible protease, induced proximity domain, and/or cytosolic sequestering domain, in the presence of the regulator protein inducer, the synTF is ON and the transcription of the gene of interest is ON; and in the absence of the regulator protein inducer, the synTF is OFF and the transcription of the gene of interest is OFF.

In embodiments wherein the synTF comprises a transcriptional repressor and a repressible protease, induced proximity domain, and/or cytosolic sequestering domain, in the presence of the regulator protein inducer, the synTF is ON and the transcription of the gene of interest is OFF; and in the absence of the regulator protein inducer, the synTF is OFF and the transcription of the gene of interest is ON.

In embodiments wherein the synTF comprises a transcriptional activator and an induced degradation domain (e.g., SMASh), in the presence of the regulator protein inducer, the synTF is OFF and the transcription of the gene of interest is OFF; and in the absence of the regulator protein inducer, the synTF is ON and the transcription of the gene of interest is ON.

In some embodiments of any of the aspects, the population of cells comprises immune cells. In some embodiments of any of the aspects, the population of immune cells comprises CD4+ T cells, CD8+ T cells, Tregs, or NK cells.

In some embodiments of any of the aspects, the regulator protein inducer is administered at the same time the population of cells is administered. In some embodiments of any of the aspects, the regulator protein inducer is administered after the population of cells is administered. As a non-limiting example, the regulator protein inducer is administered at least 1 minute, at least 2 minutes, at least 3 minutes, at least 4 minutes, at least 5 minutes, at least 10 minutes, at least 20 minutes, at least 30 minutes, at least 1 hour, at least 2 hours, at least 3 hours, at least 6 hours, at least 12 hours, at least 24 hours, at least 2 days, at least 3 days, at least 4 days, at least 5 days, at least 6 days, at least 7 days, at least 1.5 weeks, at least 2 weeks, at least 3 weeks, at least 4 weeks, at least 5 weeks, at least 6 weeks, at least 7 weeks, at least 8 weeks, at least 9 weeks, at least 10 weeks, at least 1 month, at least 2 months, at least 3 months, at least 4 months, at least 5 months, at least 6 months, at least 7 months, at least 8 months, at least 9 months, at least 10 months, at least 11 months, or at least 1 year after the population of cells is administered. In some embodiments of any of the aspects, the regulator protein inducer is administered continuously, e.g., using an IV.

Cancer

In various embodiments, a cell comprising a synTF system can be used to treat a cancer. In some embodiments, an immune cell (e.g., T cell) comprising a synTF system expressing an anti-cancer gene of interest to treat a cancer.

As used herein, the term "cancer" relates generally to a class of diseases or conditions in which abnormal cells divide without control and can invade nearby tissues. Cancer cells can also spread to other parts of the body through the blood and lymph systems. There are several main types of cancer. Carcinoma is a cancer that begins in the skin or in tissues that line or cover internal organs. Sarcoma is a cancer that begins in bone, cartilage, fat, muscle, blood vessels, or other connective or supportive tissue. Leukemia is a cancer that starts in blood-forming tissue such as the bone marrow, and causes large numbers of abnormal blood cells to be produced and enter the blood. Lymphoma and multiple myeloma are cancers that begin in the cells of the immune system. Central nervous system cancers are cancers that begin in the tissues of the brain and spinal cord.

In some embodiments of any of the aspects, the cancer is a primary cancer. In some embodiments of any of the aspects, the cancer is a malignant cancer. As used herein, the term "malignant" refers to a cancer in which a group of tumor cells display one or more of uncontrolled growth (i.e., division beyond normal limits), invasion (i.e., intrusion on and destruction of adjacent tissues), and metastasis (i.e., spread to other locations in the body via lymph or blood). As used herein, the term "metastasize" refers to the spread of cancer from one part of the body to another. A tumor formed by cells that have spread is called a "metastatic tumor" or a "metastasis." The metastatic tumor contains cells that are like those in the original (primary) tumor. As used herein, the term "benign" or "non-malignant" refers to tumors that may grow larger but do not spread to other parts of the body. Benign tumors are self-limited and typically do not invade or metastasize.

A "cancer cell" or "tumor cell" refers to an individual cell of a cancerous growth or tissue. A tumor refers generally to a swelling or lesion formed by an abnormal growth of cells, which may be benign, pre-malignant, or malignant. Most cancer cells form tumors, but some, e.g., leukemia, do not necessarily form tumors. For those cancer cells that form tumors, the terms cancer (cell) and tumor (cell) are used interchangeably.

As used herein the term "neoplasm" refers to any new and abnormal growth of tissue, e.g., an abnormal mass of tissue, the growth of which exceeds and is uncoordinated with that of the normal tissues. Thus, a neoplasm can be a benign neoplasm, premalignant neoplasm, or a malignant neoplasm.

A subject that has a cancer or a tumor is a subject having objectively measurable cancer cells present in the subject's body. Included in this definition are malignant, actively proliferative cancers, as well as potentially dormant tumors or micrometastases. Cancers which migrate from their original location and seed other vital organs can eventually lead to the death of the subject through the functional deterioration of the affected organs.

Examples of cancer include but are not limited to, carcinoma, lymphoma, blastoma, sarcoma, leukemia, basal cell carcinoma, biliary tract cancer; bladder cancer; bone cancer; brain and CNS cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma (GBM); hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); lymphoma including Hodgkin's and non-Hodgkin's lymphoma; melanoma; myeloma; neuroblastoma; oral cavity cancer (e.g., lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; as well as other carcinomas and sarcomas; as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia); chronic lymphocytic leukemia (CLL); acute lymphoblastic leukemia (ALL); Hairy cell leukemia; chronic myeloblastic leukemia; and post-transplant lymphoproliferative disorder (PTLD), as well as abnormal vascular proliferation associated with phakomatoses, edema (such as that associated with brain tumors), and Meigs' syndrome.

A "cancer cell" is a cancerous, pre-cancerous, or transformed cell, either in vivo, ex vivo, or in tissue culture, that has spontaneous or induced phenotypic changes that do not necessarily involve the uptake of new genetic material. Although transformation can arise from infection with a transforming virus and incorporation of new genomic nucleic acid, or uptake of exogenous nucleic acid, it can also arise spontaneously or following exposure to a carcinogen, thereby mutating an endogenous gene. Transformation/cancer is associated with, e.g., morphological changes, immortalization of cells, aberrant growth control, foci formation, anchorage independence, malignancy, loss of contact inhibition and density limitation of growth, growth factor or serum independence, tumor specific markers, invasiveness or metastasis, and tumor growth in suitable animal hosts such as nude mice.

Autoimmune Diseases

In various embodiments, an cell comprising a synTF system can be used to treat an autoimmune disease. In some embodiments, an immune cell (e.g., T cell) comprising a synTF system expressing a gene of interest directed against an autoimmune disease-specific antigen can be used to treat an autoimmune disease. "Autoimmune disease" refers to a class of diseases in which a subject's own antibodies react with host tissue or in which immune effector T cells are autoreactive to endogenous self-peptides and cause destruction of tissue. Thus an immune response is mounted against a subject's own antigens, referred to as self-antigens. A "self-antigen" as used herein refers to an antigen of a normal host tissue. Normal host tissue does not include neoplastic cells.

Autoantigens, as used herein, are endogenous proteins or fragments thereof that elicit this pathogenic immune response. Autoantigen can be any substance or a portion thereof normally found within a mammal that, in an autoimmune disease, becomes the primary (or a primary) target of attack by the immune system. The term also includes antigenic substances that induce conditions having the characteristics of an autoimmune disease when administered to mammals. Additionally, the term includes peptic subclasses consisting essentially of immunodominant epitopes or immunodominant epitope regions of autoantigens. Immunodominant epitopes or regions in induced autoimmune conditions are fragments of an autoantigen that can be used instead of the entire autoantigen to induce the disease. In humans afflicted with an autoimmune disease, immunodominant epitopes or regions are fragments of antigens specific to the tissue or organ under autoimmune attack and recognized by a substantial percentage (e.g. a majority though not necessarily an absolute majority) of autoimmune attack T-cells.

Autoantigens that are known to be associated with autoimmune disease include myelin proteins with demyelinating diseases, e.g. multiple sclerosis and experimental autoimmune myelitis; collagens and rheumatoid arthritis; insulin, proinsulin, glutamic acid decarboxylase 65 (GAD65); islet cell antigen (ICA512; ICA12) with insulin dependent diabetes.

A common feature in a number of autoimmune related diseases and inflammatory conditions is the involvement of pro-inflammatory CD4+ T cells. These T cells are responsible for the release of inflammatory, Th1 type cytokines. Cytokines characterized as Th1 type include interleukin 2 (IL-2), γ-interferon, TNFα and IL-12. Such pro-inflammatory cytokines act to stimulate the immune response, in many cases resulting in the destruction of autologous tissue. Cytokines associated with suppression of T cell response are the Th2 type, and include IL-10, IL-4 and TGF-β. It has been found that Th1 and Th2 type T cells may use the identical antigen receptor in response to an immunogen; in the former producing a stimulatory response and in the latter a suppressive response.

Provided herein is a method of treating an autoimmune disease, which comprises administering an effective amount of a synTF composition to a patient in need thereof. In one embodiment of any one of the methods described, the autoimmune disorder is selected from the group consisting of thyroiditis, type 1 diabetes mellitus, Hashimoto's thyroiditis, Graves' disease, celiac disease, multiple sclerosis, Guillain-Barre syndrome, Addison's disease, and Raynaud's phenomenon, Goodpasture's disease, arthritis (rheumatoid arthritis such as acute arthritis, chronic rheumatoid arthritis, gout or gouty arthritis, acute gouty arthritis, acute immunological arthritis, chronic inflammatory arthritis, degenerative arthritis, type II collagen-induced arthritis, infectious arthritis, Lyme arthritis, proliferative arthritis, psoriatic arthritis, Still's disease, vertebral arthritis, and juvenile-onset rheumatoid arthritis, arthritis chronica progrediente, arthritis deformans, polyarthritis chronica primaria, reactive arthritis, and ankylosing spondylitis), inflammatory hyperproliferative skin diseases, psoriasis such as plaque psoriasis, gutatte psoriasis, pustular psoriasis, and psoriasis of the nails, atopy including atopic diseases such as hay fever and Job's syndrome, dermatitis including contact dermatitis, chronic contact dermatitis, exfoliative dermatitis, allergic dermatitis, allergic contact dermatitis, dermatitis herpetiformis, nummular dermatitis, seborrheic dermatitis, non-specific dermatitis, primary irritant contact dermatitis, and atopic dermatitis, x-linked hyper IgM syndrome, allergic intraocular inflammatory diseases, urticaria such as chronic allergic urticaria and chronic idiopathic urticaria, including chronic autoimmune urticaria, myositis, polymyositis/dermatomyositis, juvenile dermatomyositis, toxic epidermal necrolysis, scleroderma (including systemic scleroderma), sclerosis such as systemic sclerosis, multiple sclerosis (MS) such as spino-optical MS, primary progressive MS (PPMS), and relapsing remitting MS (RRMS), progressive systemic sclerosis, atherosclerosis, arteriosclerosis, sclerosis disseminata, ataxic sclerosis, neuromyelitis optica (NMO), inflammatory bowel disease (IBD) (for example, Crohn's disease, auto-immune-mediated gastrointestinal diseases, colitis such as ulcerative colitis, colitis ulcerosa, microscopic colitis, collagenous colitis, colitis polyposa, necrotizing enterocolitis, and transmural colitis, and autoimmune inflammatory bowel disease), bowel inflammation, pyoderma gangrenosum, erythema nodosum, primary sclerosing cholangitis, respiratory distress syndrome, including adult or acute respiratory distress syndrome (ARDS), meningitis, inflammation of all or part of the uvea, iritis, choroiditis, an autoimmune hematological disorder, rheumatoid spondylitis, rheumatoid synovitis, hereditary angioedema, cranial nerve damage as in meningitis, herpes gestationis, pemphigoid gestationis, pruritis scroti, autoimmune premature ovarian failure, sudden hearing loss due to an autoimmune condition, IgE-mediated diseases such as anaphylaxis and allergic and atopic rhinitis, encephalitis such as Rasmussen's encephalitis and limbic and/or brainstem encephalitis, uveitis, such as anterior uveitis, acute anterior uveitis, granulomatous uveitis, non-granulomatous uveitis, phacoantigenic uveitis, posterior uveitis, or autoimmune uveitis, glomerulonephritis (GN) with and without nephrotic syndrome such as chronic or acute glomerulonephritis such as primary GN, immune-mediated GN, membranous GN (membranous nephropathy), idiopathic membranous GN or idiopathic membranous nephropathy, membrano- or membranous proliferative GN (MPGN), including Type I and Type II, and rapidly progressive GN, proliferative nephritis, autoimmune polyglandular endocrine failure, balanitis including balanitis circumscripta plasmacellularis, balanoposthitis, erythema annulare centrifugum, erythema dyschromicum perstans, eythema multiform, granuloma annulare, lichen nitidus, lichen sclerosus et atrophicus, lichen simplex chronicus, lichen spinulosus, lichen planus, lamellar ichthyosis, epidermolytic hyperkeratosis, premalignant keratosis, pyoderma gangrenosum, allergic conditions and responses, allergic reaction, eczema including allergic or atopic eczema, asteatotic eczema, dyshidrotic eczema, and vesicular palmoplantar eczema, asthma such as asthma bronchiale, bronchial asthma, and auto-immune asthma, conditions involving infiltration of T cells and chronic inflammatory responses, immune reactions against foreign antigens such as fetal A-B-O blood groups during pregnancy, chronic pulmonary inflammatory disease, autoimmune myocarditis, leukocyte adhesion deficiency, lupus, including lupus nephritis, lupus cerebritis, pediatric lupus, non-renal lupus, extra-renal lupus, discoid lupus and discoid lupus erythematosus, alopecia lupus, systemic lupus erythematosus (SLE) such as cutaneous SLE or subacute cutaneous SLE, neonatal lupus syndrome (NLE), and lupus erythematosus disseminatus, juvenile onset (Type I) diabetes mellitus, including pediatric insulin-dependent diabetes mellitus (IDDM), adult onset diabetes mellitus (Type II diabetes), autoimmune diabetes, idiopathic diabetes insipidus, diabetic retinopathy, diabetic nephropathy, diabetic large-artery disorder, immune responses associated with acute and delayed hypersensitivity mediated by cytokines and T-lymphocytes, sarcoidosis, granulomatosis including lymphomatoid granulomatosis, Wegener's granulomatosis, agranulocytosis, vasculitides, including vasculitis, large-vessel vasculitis (including polymyalgia rheumatica and giant-cell (Takayasu's) arteritis), medium-vessel vasculitis (including Kawasaki's disease and polyarteritis nodosa/periarteritis nodosa), microscopic polyarteritis, immunovasculitis, CNS vasculitis, cutaneous vasculitis, hypersensitivity vasculitis, necrotizing vasculitis such as systemic necrotizing vasculitis, and ANCA-associated vasculitis, such as Churg-Strauss vasculitis or syndrome (CSS) and ANCA-associated small-vessel vasculitis, temporal arteritis, autoimmune aplastic anemia, Coombs positive anemia, Diamond Blackfan anemia, hemolytic anemia or immune hemolytic anemia including autoimmune hemolytic anemia (AIHA), pernicious anemia (anemia perniciosa), Addison's disease, pure red cell anemia or aplasia (PRCA), Factor VIII deficiency, hemophilia A, autoimmune neutropenia, pancytopenia, leukopenia, diseases involving leukocyte diapedesis, CNS inflammatory disorders, multiple organ injury syndrome such as those secondary to septicemia, trauma or hemorrhage, antigen-antibody complex-mediated diseases, anti-glomerular basement membrane disease, anti-phospholipid antibody syndrome, allergic neuritis, Behcet's disease/syndrome, Castleman's syndrome, Goodpasture's syndrome, Reynaud's syndrome, Sjogren's syndrome, Stevens-Johnson syndrome, pemphigoid such as pemphigoid bullous and skin pemphigoid, pemphigus (including pemphigus vulgaris, pemphigus foliaceus, pemphigus mucus-membrane pemphigoid, and pemphigus erythematosus), autoimmune polyendocrinopathies, Reiter's disease or syndrome, an immune complex disorder such as immune complex nephritis, antibody-mediated nephritis, polyneuropathies, chronic neuropathy such as IgM polyneuropathies or IgM-mediated neuropathy, and autoimmune or immune-mediated thrombocytopenia such as idiopathic thrombocytopenic purpura (ITP) including chronic or acute ITP, scleritis such as idiopathic cerato-scleritis, episcleritis, autoimmune disease of the testis and ovary including autoimmune orchitis and oophoritis, primary hypothyroidism, hypoparathyroidism, autoimmune endocrine diseases including thyroiditis such as autoimmune thyroiditis, Hashimoto's disease, chronic thyroiditis (Hashimoto's thyroiditis), or subacute thyroiditis, idiopathic hypothyroidism, Grave's disease, polyglandular syndromes such as autoimmune polyglandular syndromes (or polyglandular endocrinopathy syndromes), paraneoplastic syndromes, including neurologic paraneoplastic syndromes such as Lambert-Eaton myasthenic syndrome or Eaton-Lambert syndrome, stiff-man or stiff-person syndrome, encephalomyelitis such as allergic encephalomyelitis or encephalomyelitis allergica and experimental allergic encephalomyelitis (EAE), myasthenia gravis such as thymoma-associated myasthenia gravis, cerebellar degeneration, neuromyotonia, opsoclonus or opsoclonus myoclonus syndrome (OMS), and sensory neuropathy, multifocal motor neuropathy, Sheehan's syndrome, autoimmune hepatitis, lupoid hepatitis, giant-cell hepatitis, autoimmune chronic active hepatitis, lymphoid interstitial pneumonitis (LIP), bronchiolitis obliterans (non-transplant) vs NSIP, Guillain-Barre syndrome, Berger's disease (IgA nephropathy), idiopathic IgA nephropathy, linear IgA dermatosis, acute febrile neutrophilic dermatosis, subcorneal pustular dermatosis, transient acantholytic dermatosis, cirrhosis such as primary biliary cirrhosis and pneumonocirrhosis, autoimmune enteropathy syndrome, Celiac or Coeliac disease, celiac sprue (gluten enteropathy), refractory sprue, idiopathic sprue, cryoglobulinemia, amylotrophic lateral sclerosis (ALS; Lou Gehrig's disease), coronary artery disease, autoimmune ear disease such as autoimmune inner ear disease (AIED), autoimmune hearing loss, polychondritis such as refractory or relapsed or relapsing polychondritis, pulmonary alveolar proteinosis, Cogan's syndrome/nonsyphilitic interstitial keratitis, Bell's palsy, Sweet's disease/syndrome, rosacea autoimmune, zoster-associated pain, amyloidosis, a non-cancerous lymphocytosis, a primary lymphocytosis, which includes monoclonal B cell lymphocytosis (e.g., benign monoclonal gammopathy and monoclonal gammopathy of undetermined significance, MGUS), peripheral neuropathy, paraneoplastic syndrome, channelopathies including channelopathies of the CNS, autism, inflammatory myopathy, focal or segmental or focal segmental glomerulosclerosis (FSGS), endocrine opthalmopathy, uveoretinitis, chorioretinitis, autoimmune hepatological disorder, fibromyalgia, multiple endocrine failure, Schmidt's syndrome, adrenalitis, gastric atrophy, presenile dementia, demyelinating diseases such as autoimmune demyelinating diseases and chronic inflammatory demyelinating polyneuropathy, Dressler's syndrome, alopecia areata, alopecia totalis, CREST syndrome (calcinosis, Raynaud's phenomenon, esophageal dysmotility, sclerodactyly, and telangiectasia), male and female autoimmune infertility, e.g., due to anti-spermatozoan antibodies, mixed connective tissue disease, Chagas' disease, rheumatic fever, recurrent abortion, farmer's lung, erythema multiforme, post-cardiotomy syndrome, Cushing's syndrome, bird-fancier's lung, allergic granulomatous angiitis, benign lymphocytic angiitis, Alport's syndrome, alveolitis such as allergic alveolitis and fibrosing alveolitis, interstitial lung disease, transfusion reaction, Sampter's syndrome, Caplan's syndrome, endocarditis, endomyocardial fibrosis, diffuse interstitial pulmonary fibrosis, interstitial lung fibrosis, pulmonary fibrosis, idiopathic pulmonary fibrosis, cystic fibrosis, endophthalmitis, erythema elevatum et diutinum, erythroblastosis fetalis, eosinophilic faciitis, Shulman's syndrome, Felty's syndrome, cyclitis such as chronic cyclitis, heterochronic cyclitis, iridocyclitis (acute or chronic), or Fuch's cyclitis, Henoch-Schonlein purpura, SCID, sepsis, endotoxemia, post-vaccination syndromes, Evan's syndrome, autoimmune gonadal failure, Sydenham's chorea, post-streptococcal nephritis, thromboangitis ubiterans, thyrotoxicosis, tabes dorsalis, chorioiditis, giant-cell polymyalgia, chronic hypersensitivity pneumonitis, keratoconjunctivitis sicca, idiopathic nephritic syndrome, minimal change nephropathy, benign familial and ischemia-reperfusion injury, transplant organ reperfusion, retinal autoimmunity, aphthae, aphthous stomatitis, arteriosclerotic disorders, aspermiogenesis, autoimmune hemolysis, Boeck's disease, enteritis allergica, erythema nodosum leprosum, idiopathic facial paralysis, chronic fatigue syndrome, febris rheumatica, Hamman-Rich's disease, sensoneural hearing loss, ileitis regionalis, leucopenia, transverse myelitis, primary idiopathic myxedema, ophthalmia symphatica, polyradiculitis acuta, pyoderma gangrenosum, acquired splenic atrophy, vitiligo, toxic-shock syndrome, conditions involving infiltration of T cells, leukocyte-adhesion deficiency, immune responses associated with acute and delayed hypersensitivity mediated by cytokines and T-lymphocytes, diseases involving leukocyte diapedesis, multiple organ injury syndrome, antigen-antibody complex-mediated diseases, antiglomerular basement membrane disease, allergic neuritis, autoimmune polyendocrinopathies, oophoritis, primary myxedema, autoimmune atrophic gastritis, rheumatic diseases, mixed connective tissue disease, nephrotic syndrome, insulitis, polyendocrine failure, autoimmune polyglandular syndrome type I, adult-onset idiopathic hypoparathyroidism (AOIH), myocarditis, nephrotic syndrome, primary sclerosing cholangitis, acute or chronic sinusitis, ethmoid, frontal, maxillary, or sphenoid sinusitis, an eosinophil-related disorder such as eosinophilia, pulmonary infiltration eosinophilia, eosinophilia-myalgia syndrome, Loffler's syndrome, chronic eosinophilic pneumonia, tropical pulmonary eosinophilia, granulomas containing eosinophils, seronegative spondyloarthritides, polyendocrine autoimmune disease, sclerosing cholangitis, sclera, episclera, Bruton's syndrome, transient hypogammaglobulinemia of infancy, Wiskott-Aldrich syndrome, ataxia telangiectasia syndrome, angiectasis, autoimmune disorders associated with collagen disease, rheumatism, allergic hypersensitivity disorders, glomerulonephritides, reperfusion injury, ischemic reperfusion disorder, lymphomatous tracheobronchitis, inflammatory dermatoses, dermatoses with acute inflammatory components, and autoimmune uveoretinitis (AUR).

Genetic Disorders

In various embodiments, a cell comprising a synTF system can be used to treat a genetic disorder. In some embodiments, a cell comprising a synTF system expressing a gene of interest that replaces a defective gene can be used to treat a genetic disorder. In some embodiments, the cell is a stem cell.

Non-limiting examples of genetic disorders that can be treated using a synTF system or cell as described herein include: hemoglobinopathies; b-Thalassemia major; a-Thalassemia major; Sickle cell anemia; Immunodeficiency Diseases; Severe combined immunodeficiency syndrome; Bare lymphocyte syndrome; Chronic granulomatous disease; Wiskott-Aldrich syndrome; Infantile agranulocytosis (Kostman's syndrome); Lazy leukocyte syndrome (neutrophil actin deficiency); Neutrophil membrane GP-180 deficiency; Agammaglobulinemia; X-linked lymphoproliferative syndrome; X-linked hyper-IgM syndrome; inborn errors of metabolism; Mucopolysaccharidoses; Hurler's disease (MPS-1) (a-iduronidase deficiency); Hurler-Scheie syndrome; Hunter disease (MPS-II) (iduronate sulfatase deficiency); Sanfillippo B (MPS-IIIB) (a-glycosaminidase deficiency); Morquio (MPS-IV) (hexosamine-6-sulfatase deficiency); Maroteaux-Lamy syndrome (MPS-VI) (arylsulfatase B deficiency); Sly syndrome (MPS-VII) (b-glucuronidase deficiency); Mucolipidoses; Fabry disease (a-galactosidase A deficiency); Gaucher disease (glucocerebrosidase deficiency); Krabbe disease (galactosylceramidase deficiency); Metachromatic leukodystrophy (arylsulfatase A deficiency; Niemann-Pick disease (sphingomyelinase deficiency; Adrenal leukodystrophy; I-cell mucolipidosis II; hematopoietic diseases; Osteopetrosis; Diamond-Blackfan syndrome; and Fanconi anemia.

VIII. Definitions

For convenience, the meaning of some terms and phrases used in the specification, examples, and appended claims, are provided below. Unless stated otherwise, or implicit from context, the following terms and phrases include the meanings provided below. The definitions are provided to aid in describing particular embodiments, and are not intended to limit the claimed invention, because the scope of the invention is limited only by the claims. Unless otherwise defined, all technical and scientific terms used herein have the same meaning as commonly understood by one of ordinary skill in the art to which this invention belongs. If there is an apparent discrepancy between the usage of a term in the art and its definition provided herein, the definition provided within the specification shall prevail.

For convenience, certain terms employed herein, in the specification, examples and appended claims are collected here.

As used herein, the term "engineered responsive reporter" or "engineered transcription unit" is a nucleic acid construct containing an engineered promoter that is operably linked to a reporter gene, and the expression of the reporter gene is controlled by upstream regulatory elements such orthogonal DNA target sequence(s) in the engineered promoter. A reporter gene is typically one where the gene product, the transcribed protein, is easily detected and monitored, e.g., the green fluorescent protein.

As used herein, the term "promoter" as used in the art, is a region of DNA that initiates transcription of a particular gene and is at which RNA polymerase binds and initiates transcription. Promoters are located near the transcription start sites of genes, on the same strand and upstream on the DNA As used herein, the term "orthogonal" when used in DNA sequences and genome biology "orthogonal" means DNA sequences that are so dissimilar from that which is naturally occurring in nature in the eukaryotic system.

As used herein, the term "responsive" in the context of an engineered promoter or engineered transcription unit or engineered responsive reporter, the term refers to whether gene transcription initiation from the promoter is enhanced or repressed when upstream nearby orthogonal DNA target sequences are bound by their respective ZF-containing synthetic transcription factors.

As used herein, the term "operably linked" when used in context of the orthogonal DNA target sequences described herein or the promoter sequence (RNA polymerase binding site) in a nucleic acid construct, an engineered responsive reporter, and in an engineered transcription unit means that the orthogonal DNA target sequences and the promoters are in-frame and in proper spatial and distance away from a nucleic acid coding for a protein or peptide or an RNA to permit the effects of the respective binding by transcription factors or RNA polymerase on transcription.

The terms "nucleic acid", "polynucleotide", and "oligonucleotide" are used interchangeably and refer to a deoxyribonucleotide (DNA) or ribonucleotide (RNA) polymer, in linear or circular conformation, and in either single- or double-stranded form. For the purposes of the present disclosure such DNA or RNA polymers may include natural nucleotides, non-natural or synthetic nucleotides, and mixtures thereof. Non-natural nucleotides may include analogues of natural nucleotides, as well as nucleotides that are modified in the base, sugar and/or phosphate moieties (e.g. phosphorothioate backbones). Non-limiting examples of modified nucleic acids are PNAs and morpholino nucleic acids. Generally an analogue of a particular nucleotide has the same base-pairing specificity, i.e. an analogue of G will base-pair with C. For the purposes of the disclosure, these terms are not to be considered limiting with respect to the length of a polymer.

A "gene", as used herein, is the segment of nucleic acid (typically DNA) that is involved in producing a polypeptide or ribonucleic acid gene product. It includes regions preceding and following the coding region (leader and trailer) as well as intervening sequences (introns) between individual coding segments (exons). Conveniently, this term also includes the necessary control sequences for gene expression (e g enhancers, silencers, promoters, terminators etc.), which may be adjacent to or distant to the relevant coding sequence, as well as the coding and/or transcribed regions encoding the gene product.

As used herein the term "modulation", in relation to the expression of a gene refers to a change in the gene's activity. Modulation includes both activation (i.e. increase in activity or expression level) and repression or inhibition of gene activity. In preferred embodiments of the disclosure, the therapeutic molecules (e.g. peptides) of the disclosure are repressors of gene expression or activity.

A nucleic acid "target", "target site" or "target sequence" or "DNA target sequence", as used herein, is a nucleic acid sequence to which a ZFA in a synTF of the disclosure will bind, provided that conditions of the binding reaction are not prohibitive. A target site may be a nucleic acid molecule or a portion of a larger polynucleotide. In accordance with the disclosure, a target sequence for a ZFA in a synTF of the disclosure may comprise a single contiguous nucleic acid sequence. These terms may also be substituted or supplemented with the terms "binding site", "binding sequence", "recognition site" or recognition sequence", which are used interchangeably.

As used herein, "binding" refers to a non-covalent interaction between macromolecules (e.g. between a ZF-array containing protein and a nucleic acid target site). In some cases binding will be sequence-specific, such as between one or more specific nucleotides (or base pairs) and one or more specific amino acids. It will be appreciated, however, that not all components of a binding interaction need be sequence-specific (e.g. non-covalent interactions with phosphate residues in a DNA backbone). Binding interactions between a nucleic acid sequence and a ZF peptide of the disclosure may be characterized by binding affinity and/or dissociation constant (Kd). A suitable dissociation constant for a ZF peptide of the disclosure binding to its target site may be in the order of 1 µM or lower, 1 nM or lower, or 1 pM or lower. "Affinity" refers to the strength of binding, such that increased binding affinity correlates with a lower Kd value. ZF synTF of the disclosure may have DNA-binding activity, RNA-binding activity, and/or even protein-binding activity. In some embodiments, the ZF synTF of the disclosure are designed or selected to have sequence specific dsDNA-binding activity. For example, the target site for a particular ZF array or protein is a sequence to which the ZF concerned is capable of nucleotide-specific binding. It will be appreciated, however, that depending on the amino acid sequence of a ZF array or protein it may bind to or recognize more than one target sequence, although typically one sequence will be bound in preference to any other recognized sequences, depending on the relative specificity of the individual non-covalent interactions. Generally, specific binding is preferably achieved with a dissociation constant (Kd) of 1 nM or lower, 100 pM or lower; or 10 pM or lower. In some embodiments, a ZF synTF of the disclosure binds to a specific target sequence with a dissociation constant of 1 nM or lower, or 1 pM or lower, or 0.1 pM or lower, or even 10 fM or lower.

By "non-target" it is meant that the nucleic acid sequence concerned is not appreciably bound by the relevant ZF peptide. In some embodiments it may be considered that, where a ZF peptide described herein has a known sequence-specific target sequence, all other nucleic acid sequences may be considered to be non-target. From a practical perspective it can be convenient to define an interaction between a non-target sequence and a particular ZF peptide as being sub-physiological (i.e. not capable of creating a physiological response under physiological target sequence/ZF peptide concentrations). For example, if any binding can be measured between the ZF peptide and the non-target sequence, the dissociation constant (Kd) is typically weaker than 1 µM, such as 10 µM or weaker, 100 µM or weaker, or at least 1 mM.

As used herein, the term "interaction" when used in the context of a receptor and its ligand refers to the binding between the receptor and its ligand as a result of the non-covalent bonds between the ligand-binding site (or fragment) of the receptor and the receptor-binding site (or fragment) of the ligand. In the context of two entities, e.g., molecules or proteins, having some binding affinity for each other, the term "interaction" refers to the binding of the two entities as a result of the non-covalent bonds between the two entities. A term "interaction", "complexing" and "bonding" are used interchangeably when used in the context of a receptor and its ligand and in the context of two binding entities.

The terms "decrease", "reduced", "reduction", or "inhibit" are all used herein to mean a decrease by a statistically significant amount. In some embodiments, "reduce," "reduction" or "decrease" or "inhibit" typically means a decrease by at least 10% as compared to a reference level (e.g. the absence of a given treatment or agent) and can include, for example, a decrease by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 98%, at least about 99%, or more. As used herein, "reduction" or "inhibition" does not encompass a complete inhibition or reduction as compared to a reference level. "Complete inhibition" is a 100% inhibition as compared to a reference level. A decrease can be preferably down to a level accepted as within the range of normal, e.g., for an individual without a given disorder.

The terms "increased", "increase", "enhance", or "activate" are all used herein to mean an increase by a statically significant amount. In some embodiments, the terms "increased", "increase", "enhance", or "activate" can mean an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level. In the context of a marker or symptom, an "increase" is a statistically significant increase in such level.

As used herein, a "subject" means a human or animal. Usually the animal is a vertebrate such as a primate, rodent, domestic animal or game animal. Primates include chimpanzees, cynomolgus monkeys, spider monkeys, and macaques, e.g., Rhesus. Rodents include mice, rats, woodchucks, ferrets, rabbits and hamsters. Domestic and game animals include cows, horses, pigs, deer, bison, buffalo, feline species, e.g., domestic cat, canine species, e.g., dog, fox, wolf, avian species, e.g., chicken, emu, ostrich, and fish, e.g., trout, catfish and salmon. In some embodiments, the subject is a mammal, e.g., a primate, e.g., a human. The terms, "individual," "patient" and "subject" are used interchangeably herein.

Preferably, the subject is a mammal. The mammal can be a human, non-human primate, mouse, rat, dog, cat, horse, or cow, but is not limited to these examples. Mammals other than humans can be advantageously used as subjects that represent animal models of cancer. A subject can be male or female.

A subject can be one who has been previously diagnosed with or identified as suffering from or having a condition in need of treatment (e.g. cancer) or one or more complications related to such a condition, and optionally, have already undergone treatment for the disease or disorder (e.g., cancer) or the one or more complications related to the disease or disorder (e.g., cancer). Alternatively, a subject can also be one who has not been previously diagnosed as having the disease or disorder (e.g., cancer) or one or more complications related to the disease or disorder (e.g., cancer). For example, a subject can be one who exhibits one or more risk factors for the disease or disorder (e.g., cancer) or one or more complications related to the disease or disorder (e.g., cancer) or a subject who does not exhibit risk factors.

A "subject in need" of treatment for a particular condition can be a subject having that condition, diagnosed as having that condition, or at risk of developing that condition.

As used herein, the terms "protein" and "polypeptide" are used interchangeably to designate a series of amino acid residues, connected to each other by peptide bonds between the alpha-amino and carboxy groups of adjacent residues. The terms "protein", and "polypeptide" refer to a polymer of amino acids, including modified amino acids (e.g., phosphorylated, glycated, glycosylated, etc.) and amino acid analogs, regardless of its size or function. "Protein" and "polypeptide" are often used in reference to relatively large polypeptides, whereas the term "peptide" is often used in reference to small polypeptides, but usage of these terms in the art overlaps. The terms "protein" and "polypeptide" are used interchangeably herein when referring to a gene product and fragments thereof. Thus, exemplary polypeptides or proteins include gene products, naturally occurring proteins, homologs, orthologs, paralogs, fragments and other equivalents, variants, fragments, and analogs of the foregoing.

In the various embodiments described herein, it is further contemplated that variants (naturally occurring or otherwise), alleles, homologs, conservatively modified variants, and/or conservative substitution variants of any of the particular polypeptides described are encompassed. As to amino acid sequences, one of skill will recognize that individual substitutions, deletions or additions to a nucleic acid, peptide, polypeptide, or protein sequence which alters a single amino acid or a small percentage of amino acids in the encoded sequence is a "conservatively modified variant" where the alteration results in the substitution of an amino acid with a chemically similar amino acid and retains the desired activity of the polypeptide. Such conservatively modified variants are in addition to and do not exclude polymorphic variants, interspecies homologs, and alleles consistent with the disclosure.

A given amino acid can be replaced by a residue having similar physiochemical characteristics, e.g., substituting one aliphatic residue for another (such as Ile, Val, Leu, or Ala for one another), or substitution of one polar residue for another (such as between Lys and Arg; Glu and Asp; or Gln and Asn). Other such conservative substitutions, e.g., substitutions of entire regions having similar hydrophobicity characteristics, are well known. Polypeptides comprising conservative amino acid substitutions can be tested in any one of the assays described herein to confirm that a desired activity, e.g. function and specificity of a native or reference polypeptide is retained.

Amino acids can be grouped according to similarities in the properties of their side chains (in A. L. Lehninger, in Biochemistry, second ed., pp. 73-75, Worth Publishers, New York (1975)): (1) non-polar: Ala (A), Val (V), Leu (L), Ile (I), Pro (P), Phe (F), Trp (W), Met (M); (2) uncharged polar: Gly (G), Ser (S), Thr (T), Cys (C), Tyr (Y), Asn (N), Gln (Q); (3) acidic: Asp (D), Glu (E); (4) basic: Lys (K), Arg (R), His (H). Alternatively, naturally occurring residues can be divided into groups based on common side-chain properties: (1) hydrophobic: Norleucine, Met, Ala, Val, Leu, Ile; (2) neutral hydrophilic: Cys, Ser, Thr, Asn, Gln; (3) acidic: Asp, Glu; (4) basic: His, Lys, Arg; (5) residues that influence chain orientation: Gly, Pro; (6) aromatic: Trp, Tyr, Phe. Non-conservative substitutions will entail exchanging a member of one of these classes for another class. Particular conservative substitutions include, for example; Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

In some embodiments, the polypeptide described herein (or a nucleic acid encoding such a polypeptide) can be a functional fragment of one of the amino acid sequences described herein. As used herein, a "functional fragment" is a fragment or segment of a peptide which retains at least 50% of the wild-type reference polypeptide's activity according to the assays described below herein. A functional fragment can comprise conservative substitutions of the sequences disclosed herein. In some embodiments of any of the aspects, a polypeptide can comprise the first N-terminal amino acid methionine. In embodiments where a polypeptide does not comprise a first N-terminal methionine, it is understood that a variant of the polypeptide does comprise a first N-terminal methionine.

In some embodiments, the polypeptide described herein can be a variant of a sequence described herein. In some embodiments, the variant is a conservatively modified variant. Conservative substitution variants can be obtained by mutations of native nucleotide sequences, for example. A "variant," as referred to herein, is a polypeptide substantially homologous to a native or reference polypeptide, but which has an amino acid sequence different from that of the native or reference polypeptide because of one or a plurality of deletions, insertions or substitutions. Variant polypeptide-encoding DNA sequences encompass sequences that comprise one or more additions, deletions, or substitutions of nucleotides when compared to a native or reference DNA sequence, but that encode a variant protein or fragment thereof that retains activity. A wide variety of PCR-based site-specific mutagenesis approaches are known in the art and can be applied by the ordinarily skilled artisan.

A variant amino acid or DNA sequence can be at least 70%, at least 75%, at least 80%, at least 85%, at least 90%, at least 91%, at least 92%, at least 93%, at least 94%, at least 95%, at least 96%, at least 97%, at least 98%, at least 99%, or more, identical to a native or reference sequence. The degree of homology (percent identity) between a native and a mutant sequence can be determined, for example, by comparing the two sequences using freely available computer programs commonly employed for this purpose on the world wide web (e.g. BLASTp or BLASTn with default settings).

Alterations of the native amino acid sequence can be accomplished by any of a number of techniques known to one of skill in the art. Mutations can be introduced, for example, at particular loci by synthesizing oligonucleotides containing a mutant sequence, flanked by restriction sites enabling ligation to fragments of the native sequence. Following ligation, the resulting reconstructed sequence encodes an analog having the desired amino acid insertion, substitution, or deletion. Alternatively, oligonucleotide-directed site-specific mutagenesis procedures can be employed to provide an altered nucleotide sequence having particular codons altered according to the substitution, deletion, or insertion required. Techniques for making such alterations are very well established and include, for example, those disclosed by Walder et al. (Gene 42:133, 1986); Bauer et al. (Gene 37:73, 1985); Craik (BioTechniques, Jan. 1985, 12-19); Smith et al. (Genetic Engineering: Principles and Methods, Plenum Press, 1981); and U.S. Pat. Nos. 4,518,584 and 4,737,462, which are herein incorporated by reference in their entireties. Any cysteine residue not involved in maintaining the proper conformation of the polypeptide also can be substituted, generally with serine, to improve the oxidative stability of the molecule and prevent aberrant crosslinking. Conversely, cysteine bond(s) can be added to the polypeptide to improve its stability or facilitate oligomerization.

As used herein, the term "nucleic acid" or "nucleic acid sequence" refers to any molecule, preferably a polymeric molecule, incorporating units of ribonucleic acid, deoxyribonucleic acid or an analog thereof. The nucleic acid can be either single-stranded or double-stranded. A single-stranded nucleic acid can be one nucleic acid strand of a denatured double-stranded DNA. Alternatively, it can be a single-stranded nucleic acid not derived from any double-stranded DNA. In one aspect, the nucleic acid can be DNA. In another aspect, the nucleic acid can be RNA. Suitable DNA can include, e.g., genomic DNA, cDNA, or vector DNA. Suitable RNA can include, e.g., mRNA.

The term "expression" refers to the cellular processes involved in producing RNA and proteins and as appropriate, secreting proteins, including where applicable, but not limited to, for example, transcription, transcript processing, translation and protein folding, modification and processing. Expression can refer to the transcription and stable accumulation of sense (e.g., mRNA) or antisense RNA derived from a nucleic acid fragment or fragments and/or to the translation of mRNA into a polypeptide.

As used herein, the term "detecting" or "measuring" refers to observing a signal from, e.g. a probe, label, or target molecule to indicate the presence of an analyte in a sample. Any method known in the art for detecting a particular label moiety can be used for detection. Exemplary detection methods include, but are not limited to, spectroscopic, fluorescent, photochemical, biochemical, immunochemical, electrical, optical or chemical methods. In some embodiments of any of the aspects, measuring can be a quantitative observation.

In some embodiments of any of the aspects, a polypeptide, nucleic acid, or cell as described herein can be engineered. As used herein, "engineered" refers to the aspect of having been manipulated by the hand of man. For example, a polypeptide is considered to be "engineered" when at least one aspect of the polypeptide, e.g., its sequence, has been manipulated by the hand of man to differ from the aspect as it exists in nature. As is common practice and is understood by those in the art, progeny of an engineered cell are typically still referred to as "engineered" even though the actual manipulation was performed on a prior entity.

In some embodiments of any of the aspects, the synTF polypeptides described herein is exogenous. In some embodiments of any of the aspects, the synTF polypeptides described herein is ectopic. In some embodiments of any of the aspects, the synTF polypeptides described herein is not endogenous.

The term "exogenous" refers to a substance present in a cell other than its native source. The term "exogenous" when used herein can refer to a nucleic acid (e.g. a nucleic acid encoding a polypeptide) or a polypeptide that has been introduced by a process involving the hand of man into a biological system such as a cell or organism in which it is not normally found and one wishes to introduce the nucleic acid or polypeptide into such a cell or organism. Alternatively, "exogenous" can refer to a nucleic acid or a polypeptide that has been introduced by a process involving the hand of man into a biological system such as a cell or organism in which it is found in relatively low amounts and one wishes to increase the amount of the nucleic acid or polypeptide in the cell or organism, e.g., to create ectopic expression or levels. In contrast, the term "endogenous" refers to a substance that is native to the biological system or cell. As used herein, "ectopic" refers to a substance that is found in an unusual location and/or amount. An ectopic substance can be one that is normally found in a given cell, but at a much lower amount and/or at a different time. Ectopic also includes substance, such as a polypeptide or nucleic acid that is not naturally found or expressed in a given cell in its natural environment.

As described herein, an "antigen" is a molecule that is bound by a binding site on an antibody agent (e.g., extracellular binding domain). Typically, antigens are bound by antibody ligands and are capable of raising an antibody response in vivo. An antigen can be a polypeptide, protein, nucleic acid or other molecule or portion thereof. The term "antigenic determinant" refers to an epitope on the antigen recognized by an antigen-binding molecule, and more particularly, by the antigen-binding site of said molecule.

In some embodiments, a nucleic acid encoding a polypeptide as described herein (e.g. a synTF polypeptide) is comprised by a vector. In some of the aspects described herein, a nucleic acid sequence encoding a given polypeptide as described herein, or any module thereof, is operably linked to a vector. The term "vector", as used herein, refers to a nucleic acid construct designed for delivery to a host cell or for transfer between different host cells. As used herein, a vector can be viral or non-viral. The term "vector" encompasses any genetic element that is capable of replication when associated with the proper control elements and that can transfer gene sequences to cells. A vector can include, but is not limited to, a cloning vector, an expression vector, a plasmid, phage, transposon, cosmid, chromosome, virus, virion, etc.

In some embodiments of any of the aspects, the vector is recombinant, e.g., it comprises sequences originating from at least two different sources. In some embodiments of any of the aspects, the vector comprises sequences originating from at least two different species. In some embodiments of any of the aspects, the vector comprises sequences originating from at least two different genes, e.g., it comprises a fusion protein or a nucleic acid encoding an expression product which is operably linked to at least one non-native (e.g., heterologous) genetic control element (e.g., a promoter, suppressor, activator, enhancer, response element, or the like).

As used herein, the term "expression vector" refers to a vector that directs expression of an RNA or polypeptide from sequences linked to transcriptional regulatory sequences on the vector. The sequences expressed will often, but not necessarily, be heterologous to the cell. An expression vector may comprise additional elements, for example, the expression vector may have two replication systems, thus allowing it to be maintained in two organisms, for example in human cells for expression and in a prokaryotic host for cloning and amplification.

As used herein, the term "viral vector" refers to a nucleic acid vector construct that includes at least one element of viral origin and has the capacity to be packaged into a viral vector particle. The viral vector can contain the nucleic acid encoding a polypeptide as described herein in place of non-essential viral genes. The vector and/or particle may be utilized for the purpose of transferring any nucleic acids into cells either in vitro or in vivo. Numerous forms of viral vectors are known in the art. Non-limiting examples of a viral vector of this invention include an AAV vector, an adenovirus vector, a lentivirus vector, a retrovirus vector, a herpesvirus vector, an alphavirus vector, a poxvirus vector a baculovirus vector, and a chimeric virus vector.

It should be understood that the vectors described herein can, in some embodiments, be combined with other suitable compositions and therapies. In some embodiments, the vector is episomal. The use of a suitable episomal vector provides a means of maintaining the nucleotide of interest in the subject in high copy number extra chromosomal DNA thereby eliminating potential effects of chromosomal integration.

As used herein, the terms "treat," "treatment," "treating," or "amelioration" refer to therapeutic treatments, wherein the object is to reverse, alleviate, ameliorate, inhibit, slow down or stop the progression or severity of a condition associated with a disease or disorder, e.g. cancer. The term "treating" includes reducing or alleviating at least one adverse effect or symptom of a condition, disease or disorder associated with the disease or disorder (e.g., cancer, autoimmunity, genetic disorder). Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation of, or at least slowing of, progress or worsening of symptoms compared to what would be expected in the absence of treatment. Beneficial or desired clinical results include, but are not limited to, alleviation of one or more symptom(s), diminishment of extent of disease, stabilized (i.e., not worsening) state of disease, delay or slowing of disease progression, amelioration or palliation of the disease state, remission (whether partial or total), and/or decreased mortality, whether detectable or undetectable. The term "treatment" of a disease also includes providing relief from the symptoms or side-effects of the disease (including palliative treatment).

As used herein, the term "pharmaceutical composition" refers to the active agent in combination with a pharmaceutically acceptable carrier e.g. a carrier commonly used in the pharmaceutical industry. The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio. In some embodiments of any of the aspects, a pharmaceutically acceptable carrier can be a carrier other than water. In some embodiments of any of the aspects, a pharmaceutically acceptable carrier can be a cream, emulsion, gel, liposome, nanoparticle, and/or ointment. In some embodiments of any of the aspects, a pharmaceutically acceptable carrier can be an artificial or engineered carrier, e.g., a carrier that the active ingredient would not be found to occur in or within nature.

As used herein, the term "administering," refers to the placement of a compound as disclosed herein into a subject by a method or route which results in at least partial delivery of the agent at a desired site. Pharmaceutical compositions comprising the compounds disclosed herein can be administered by any appropriate route which results in an effective treatment in the subject. In some embodiments, administration comprises physical human activity, e.g., an injection, act of ingestion, an act of application, and/or manipulation of a delivery device or machine. Such activity can be performed, e.g., by a medical professional and/or the subject being treated.

As used herein, "contacting" refers to any suitable means for delivering, or exposing, an agent to at least one cell. Exemplary delivery methods include, but are not limited to, direct delivery to cell culture medium, transfection, transduction, perfusion, injection, or other delivery method known to one skilled in the art. In some embodiments, contacting comprises physical human activity, e.g., an injection; an act of dispensing, mixing, and/or decanting; and/or manipulation of a delivery device or machine.

As used herein, the term "analog" refers to a substance that shares one or more particular structural features, elements, components, or moieties with a reference substance. Typically, an "analog" shows significant structural similarity with the reference substance, for example sharing a core or consensus structure, but also differs in certain discrete ways. In some embodiments, an analog is a substance that can be generated from the reference substance, e.g., by chemical manipulation of the reference substance.

The term "statistically significant" or "significantly" refers to statistical significance and generally means a two standard deviation (2SD) or greater difference.

Other than in the operating examples, or where otherwise indicated, all numbers expressing quantities of ingredients or reaction conditions used herein should be understood as modified in all instances by the term "about." The term "about" when used in connection with percentages can mean±1%.

As used herein, the term "comprising" means that other elements can also be present in addition to the defined elements presented. The use of "comprising" indicates inclusion rather than limitation.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of additional elements that do not materially affect the basic and novel or functional characteristic(s) of that embodiment of the invention.

As used herein, the term "corresponding to" refers to an amino acid or nucleotide at the enumerated position in a first polypeptide or nucleic acid, or an amino acid or nucleotide that is equivalent to an enumerated amino acid or nucleotide in a second polypeptide or nucleic acid. Equivalent enumerated amino acids or nucleotides can be determined by alignment of candidate sequences using degree of homology programs known in the art, e.g., BLAST.

As used herein, the term "specific binding" refers to a chemical interaction between two molecules, compounds, cells and/or particles wherein the first entity binds to the second, target entity with greater specificity and affinity than it binds to a third entity which is a non-target. In some embodiments, specific binding can refer to an affinity of the first entity for the second target entity which is at least 10 times, at least 50 times, at least 100 times, at least 500 times, at least 1000 times or greater than the affinity for the third non-target entity. A reagent specific for a given target is one that exhibits specific binding for that target under the conditions of the assay being utilized.

The singular terms "a," "an," and "the" include plural referents unless context clearly indicates otherwise. Similarly, the word "or" is intended to include "and" unless the context clearly indicates otherwise. Although methods and materials similar or equivalent to those described herein can be used in the practice or testing of this disclosure, suitable methods and materials are described below. The abbreviation, "e.g." is derived from the Latin exempli gratia, and is used herein to indicate a non-limiting example. Thus, the abbreviation "e.g." is synonymous with the term "for example."

Groupings of alternative elements or embodiments of the invention disclosed herein are not to be construed as limitations. Each group member can be referred to and claimed individually or in any combination with other members of the group or other elements found herein. One or more members of a group can be included in, or deleted from, a group for reasons of convenience and/or patentability. When any such inclusion or deletion occurs, the specification is herein deemed to contain the group as modified thus fulfilling the written description of all Markush groups used in the appended claims.

Unless otherwise defined herein, scientific and technical terms used in connection with the present application shall have the meanings that are commonly understood by those of ordinary skill in the art to which this disclosure belongs. It should be understood that this invention is not limited to the particular methodology, protocols, and reagents, etc., described herein and as such can vary. The terminology used herein is for the purpose of describing particular embodiments only, and is not intended to limit the scope of the present invention, which is defined solely by the claims. Definitions of common terms in immunology and molecular biology can be found in The Merck Manual of Diagnosis and Therapy, 20th Edition, published by Merck Sharp & Dohme Corp., 2018 (ISBN 0911910190, 978-0911910421); Robert S. Porter et al. (eds.), The Encyclopedia of Molecular Cell Biology and Molecular Medicine, published by Blackwell Science Ltd., 1999-2012 (ISBN 9783527600908); and Robert A. Meyers (ed.), Molecular Biology and Biotechnology: a Comprehensive Desk Reference, published by VCH Publishers, Inc., 1995 (ISBN 1-56081-569-8); Immunology by Werner Luttmann, published by Elsevier, 2006; Janeway's Immunobiology, Kenneth Murphy, Allan Mowat, Casey Weaver (eds.), W. W. Norton & Company, 2016 (ISBN 0815345054, 978-0815345053); Lewin's Genes XI, published by Jones & Bartlett Publishers, 2014 (ISBN-1449659055); Michael Richard Green and Joseph Sambrook, Molecular Cloning: A Laboratory Manual, 4th ed., Cold Spring Harbor Laboratory Press, Cold Spring Harbor, N.Y., USA (2012) (ISBN 1936113414); Davis et al., Basic Methods in Molecular Biology, Elsevier Science Publishing, Inc., New York, USA (2012) (ISBN 044460149X); Laboratory Methods in Enzymology: DNA, Jon Lorsch (ed.) Elsevier, 2013 (ISBN 0124199542); Current Protocols in Molecular Biology (CPMB), Frederick M. Ausubel (ed.), John Wiley and Sons, 2014 (ISBN 047150338X, 9780471503385), Current Protocols in Protein Science (CPPS), John E. Coligan (ed.), John Wiley and Sons, Inc., 2005; and Current Protocols in Immunology (CPI) (John E. Coligan, ADA M Kruisbeek, David H Margulies, Ethan M Shevach, Warren Strobe, (eds.) John Wiley and Sons, Inc., 2003 (ISBN 0471142735, 9780471142737), the contents of which are all incorporated by reference herein in their entireties.

One of skill in the art can readily identify a chemotherapeutic agent of use (e.g. see Physicians' Cancer Chemotherapy Drug Manual 2014, Edward Chu, Vincent T. DeVita Jr., Jones & Bartlett Learning; Principles of Cancer Therapy, Chapter 85 in Harrison's Principles of Internal Medicine, 18th edition; Therapeutic Targeting of Cancer Cells: Era of Molecularly Targeted Agents and Cancer Pharmacology, Chs. 28-29 in Abeloff's Clinical Oncology, 2013 Elsevier; and Fischer D S (ed): The Cancer Chemotherapy Handbook, 4th ed. St. Louis, Mosby-Year Book, 2003).

In some embodiments of any of the aspects, the disclosure described herein does not concern a process for cloning human beings, processes for modifying the germ line genetic identity of human beings, uses of human embryos for industrial or commercial purposes or processes for modifying the genetic identity of animals which are likely to cause them suffering without any substantial medical benefit to man or animal, and also animals resulting from such processes.

Other terms are defined herein within the description of the various aspects of the invention.

All patents and other publications; including literature references, issued patents, published patent applications, and co-pending patent applications; cited throughout this application are expressly incorporated herein by reference for the purpose of describing and disclosing, for example, the methodologies described in such publications that might be used in connection with the technology described herein. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

The description of embodiments of the disclosure is not intended to be exhaustive or to limit the disclosure to the precise form disclosed. While specific embodiments of, and examples for, the disclosure are described herein for illustrative purposes, various equivalent modifications are possible within the scope of the disclosure, as those skilled in the relevant art will recognize. For example, while method steps or functions are presented in a given order, alternative embodiments may perform functions in a different order, or functions may be performed substantially concurrently. The teachings of the disclosure provided herein can be applied to other procedures or methods as appropriate. The various embodiments described herein can be combined to provide further embodiments. Aspects of the disclosure can be modified, if necessary, to employ the compositions, functions and concepts of the above references and application to provide yet further embodiments of the disclosure. Moreover, due to biological functional equivalency considerations, some changes can be made in protein structure without affecting the biological or chemical action in kind or amount. These and other changes can be made to the disclosure in light of the detailed description. All such modifications are intended to be included within the scope of the appended claims.

Specific elements of any of the foregoing embodiments can be combined or substituted for elements in other embodiments. Furthermore, while advantages associated with certain embodiments of the disclosure have been described in the context of these embodiments, other embodiments may also exhibit such advantages, and not all embodiments need necessarily exhibit such advantages to fall within the scope of the disclosure.

The technology described herein is further illustrated by the following examples which in no way should be construed as being further limiting.

Some embodiments of the technology described herein can be defined according to any of the following numbered paragraphs:
1. A synthetic transcription factor (synTF) comprising;
   a. at least one DNA binding domain (DBD),
   b. a transcriptional effector domain (ED),
   c. at least one regulator protein (RP), and
      wherein the ED is directly or indirectly coupled or linked to the DBD, and
      wherein the coupling is regulated by the at least one RP, or
      wherein the cellular localization of the ED is regulated by the at least one regulator protein.
2. The synTF of paragraph 1, wherein the transcriptional ED is a transcriptional activator (TA) domain.
3. The synTF of paragraph 2, wherein the TA is selected from the group consisting of: p65; Rta; miniVPR; full VPR; VP16; VP64; p300; p300 HAT Core; and a CBP HAT domain.

4. The synTF of paragraph 2, wherein the TA is p65, or a variant thereof
5. The synTF of paragraph 4, wherein the p65 comprises one of SEQ ID NOs: 69, 117-121, 193-197 or a protein having at least 85% sequence identity one of SEQ ID NOs: 69, 117-121, 193-197.
6. The synTF of paragraph 1, wherein the transcriptional ED is a transcriptional repressor (TR) domain.
7. The synTF of paragraph 6, wherein the TR is selected from the group consisting of: KRAB; KRAB-MeCP2; Hp1a; DNMT3B; EED; and HDAC4.
8. The synTF of paragraph 6, wherein the TR is KRAB, or a variant thereof
9. The synTF of paragraph 8, wherein the KRAB comprises one of SEQ ID NOs: 72, 97, or 214-215, or a protein having at least 85% sequence identity to one of SEQ ID NO: 72, 97, or 214-215.
10. The synTF of paragraph 1, wherein the at least one DBD is an engineered zinc finger (ZF) binding domain.
11. The synTF of any of paragraph 10, wherein the ZF-binding domain comprises 2 or more ZF motifs.
12. The synTF of any of paragraph 11, wherein the ZF-binding domain comprises any one of: 3, 4, 5, 6, 7, 8, 9, 10, 11, 12, 13, 14, 15, 16, 17, 18, or more ZF motifs arranged adjacent to each other in tandem to form a ZF array (ZFA).
13. The synTF of any of paragraphs 1-12, wherein the ZF binding domain is selected from any of: ZF 1-1, ZF 1-2, ZF 1-3, ZF 1-4, ZF 1-5, ZF 1-6, ZF 1-7, ZF 1-8, ZF 2-1, ZF 2-2, ZF 2-3, ZF 2- 4, ZF 2-5, ZF 2-6, ZF 2-7, ZF 2-8, ZF 3-1, ZF 3-2, ZF 3-3, ZF 3-4, ZF 3-5, ZF 3-6, ZF 3-7, ZF 3- 8, ZF 4-1, ZF 4-2, ZF 4-3, ZF 4-4, ZF 4-5, ZF 4-6, ZF 4-7, ZF 4-8, ZF 5-1, ZF 5-2, ZF 5-3, ZF 5- 4, ZF 5-5, ZF 5-6, ZF 5-7, ZF 5-8, ZF 6-1, ZF 6-2, ZF 6-3, ZF 6-4, ZF 6-5, ZF 6-6, ZF 6-7, ZF 6- 8, ZF 7-1, ZF 7-2, ZF 7-3, ZF 7-4, ZF 7-5, ZF 7-6, ZF 7-7, ZF 7-8, ZF 8-1, ZF 8-2, ZF 8-3, ZF 8- 4, ZF 9-1, ZF 9-2, ZF 9-3, ZF 9-4, ZF 10-1 and ZF 11-1.
14. The synTF of any of paragraphs 1-13, wherein the ZF binding domain is selected from any of SEQ ID NOs: 1-3, 76, 101, 377, or 380.
15. The synTF of paragraph 14, wherein the ZF binding domain specifically binds to a sequence comprising at least one of SEQ ID NOs: 181-191.
16. The synTF of any one of paragraphs 1-15, wherein the at least one DBD is selected from one or more of any of: SEQ ID NO: 221 or 222, 36-4 (SEQ ID NO: 223), 43-8 (SEQ ID NO: 224 or 225), 42-10 (SEQ ID NO: 226 or 227), 97-4 (SEQ ID NO: 228), or wherein the DBD binds to DNA binding motifs (DBM) comprising any of: SEQ ID NOs: 229-240.
17. The synTF of paragraph 1, wherein the regulator protein is located between the DBD and the transcriptional effector domain.
18. The synTF of paragraph any of paragraphs 1-17, wherein the regulator protein is a repressible protease.
19. The synTF of any of paragraphs 1-18, wherein the regulator protein is a NS3 protease protein.
20. The synTF of any of paragraphs 1-19, wherein the regulator protein comprises the amino acid of SEQ ID NOs: 82, 85, 91, 102, 241-255, 304-315, or a homologue of at least 85% sequence identity to SEQ ID NOs: 82, 85, 91, 102, 241-255, 304-315.
21. The synTF of any of paragraphs 1-19, wherein in the presence of a protease inhibitor, or an inhibitor of NS3 the NS3 protease protein is inhibited, thereby maintaining the coupling of the DBD to the effector domain.
22. The synTF of any of paragraphs 1-19, wherein in the absence of a protease inhibitor or an inhibitor to NS3, the NS3 protease protein is active and result in its excision from the DBD, thereby uncoupling the linkage between the DBD and the effector domain.
23. The synTF of paragraph 21 or 22, wherein an inhibitor of NS3 is selected from any of: grazoprevir (GRZ/GZV), danoprevir, simeprevir, asunaprevir, ciluprevir, boceprevir, sovaprevir, paritaprevir, ombitasvir, paritaprevir, ritonavir, dasabuvir, and telaprevir
24. The synTF of paragraph 1, wherein the at least one RP is a pair of induced proximity domains (IPD pair), wherein the IPD pair comprises:
    a first induced proximity domain (IPD$^A$) and at least a second complementary IPD (IPD$^B$),
    wherein in the presence of an inducer agent or inducer signal, the IPD$^A$ and IPD$^B$ come together resulting in the linkage of the ED to the DBD of the synthetic TF, and
    wherein in the absence of an inducer agent or inducer signal, the ED is uncoupled or unlinked to the DBD of the synthetic TF.
25. The synTF of paragraph 24, wherein the induced proximity domain pair (IPD pair) comprises a IPD$^A$ and IPD$^B$ selected from any one or more of:
    a. a IPD$^A$ comprising a GID1 domain or a fragment thereof, and a IPD$^B$ comprising a GAI domain, wherein the GID1 domain and GAI domain bind to the inducer agent Gibberellin Ester (GIB);
    b. a IPD$^A$ comprising a FKBP domain or a fragment thereof, and a IPD$^B$ comprising a FRB domain, wherein the FKBP domain and FRB domain bind to the inducer agent Rapalog (RAP);
    c. a IPD$^A$ comprising a PYL domain or a fragment thereof, and a IPD$^B$ comprising a ABI domain, wherein the PYL domain and ABI domain bind to the inducer agent Abscisic acid (ABA);
    d. a IPD$^A$ comprising a Light-inducible dimerization domain (LIDD), wherein a LIDD dimerizes with a complementary LIDD (IPD$^B$) upon exposure to a light inducer signal of an appropriate wavelength.
26. The synTF of paragraph 24, wherein the induced proximity domain pair (IPD pair) comprises a IPD$^A$ and IPD$^B$ comprising a PYL domain or a fragment thereof and a ABI domain, wherein the PYL domain and ABI domain bind to the inducer agent Abscisic acid (ABA).
27. The synTF of paragraph 24, wherein the LIDD is nMag or CIBN or a photochromic protein domain, wherein nMag can dimerize with the complementary LIDD pMag upon exposure to a blue light inducer signal, and wherein CIBN can dimerize with the complementary CRY2 upon exposure to a blue inducer light signal, and wherein the photochromic proteins can dimerize upon exposure to a blue inducer light signal.
28. The synTF of paragraph 24, wherein the light inducer signal is a pulse light signal.
29. The synTF of any of paragraphs 1-17, wherein the at least one RP is a cytosolic sequestering protein.
30. The synTF of paragraph 29, wherein the sequestering protein comprises a ligand binding domain (LBD), wherein in the presence of the ligand, the sequestering of the protein to the cytosol is inhibited.
31. The synTF of paragraph 29, wherein the cytosolic sequestering protein comprises a ligand binding domain and a nuclear localization signal (NLS), wherein in the absence of the ligand the NLS is inhibited thereby preventing translocation of the sequestering protein to the nucleus, and wherein in the presence of the ligand the nuclear localization signal is exposed enabling translocation of the sequestering protein to the nucleus.

32. The synTF of any of paragraphs 29-31, wherein the sequestering protein comprises at least a portion of the estrogen receptor (ER).

33. The synTF of any of paragraphs 29-32, wherein the sequestering protein comprises an estrogen ligand binding domain (ERT) or a variant thereof, selected from the group consisting of: ERT2, ERT, and ERT3.

34. The synTF of paragraph 33, wherein the ERT binds to one or more ligands selected from: tamoxifen, 4-hydroxytamoxifen (4OHT), endoxifen, Fulvestrant, wherein binding of the ligand to ERT exposes the NLS and results in nuclear translocation of the ERT.

35. The synTF of paragraph 29, wherein the cytosolic sequestering protein comprises a transmembrane receptor sequestering protein.

36. The synTF of any of paragraphs 1-35, wherein the synTF comprises a N-terminal DBD, the sequestering protein, and a C-terminal effector domain.

37. The synTF of paragraph 36, wherein the effector domain is a transcriptional activator (TA).

38. The synTF of any of paragraphs 1-35, wherein the synTF comprises a N-terminal effector domain, a DBD and a C-terminal cytosolic sequestering protein.

39. The synTF of paragraph 38, wherein the effector domain is a transcriptional repressor (TR).

40. The synTF of any of paragraphs 1-23, wherein the NS3 protein is part of a Small molecule-Assisted Shutoff (SMASh) domain, wherein the SMASh domain comprises the NS3 protein, a partial protease helical domain and a NS4A domain.

41. The synTF of any of paragraphs 1-9 and 24-40, wherein synTF further comprises a Small molecule-Assisted Shutoff (SMASh) tag, wherein the SMASh tag is a N-terminal or C-terminal SMASh domain comprising a repressible protease, a partial protease helical domain and a cofactor domain.

42. The synTF of paragraph 41, wherein the SMASh tag is a C-terminal SMASh domain comprising in a N-terminal to C-terminal order: a NS3 cleavage site, at least one linker, a NS3 domain, a NS3 partial helicase, a NS4A domain, wherein the SMASh tag is fused to the C-terminus of the effector domain of the synTF.

43. The synTF of paragraph 41, wherein the SMASh tag is a N-terminal SMASh domain comprising in a N-terminal to C-terminal order: at least one Linker, a NS3 domain, a NS3 partial helicase, a NS4 domain, and a NS3 cleavage site, wherein the SMASh tag is fused to the N-terminus of the synTF.

44. The synTF of paragraphs 40-43, wherein in the absence of an inhibitor for the NS3 protease, the NS3 protease is active and self cleaves/uncouples from the synTF, thereby resulting in the SMASh tag targeted for degradation ("SMASh-degradation", synTF-on/TA-on/RP-on), and wherein in the presence of an inhibitor for NS3 protease, NS3 protease activity is inhibited thereby resulting in the SMASh tagged synTF targeted for degradation ("synTF-degradation", synTF-OFF/TA-off/RP-off).

45. The synTF of paragraph 44, wherein the inhibitor for NS3 protease is selected from any of: grazoprevir (GRZ/GZV), danoprevir, simeprevir, asunaprevir, ciluprevir, boceprevir, sovaprevir, paritaprevir, ombitasvir, paritaprevir, ritonavir, dasabuvir, and telaprevir.

46. The synTF of any one of paragraphs 24-45, wherein the synTF comprises a SMASh tag and a cytosolic sequestering protein.

47. The synTF of paragraph 46, wherein the synTF is active in the presence of the ligand for the cytosolic sequestering protein and the absence of the inhibitor for the NS3 protease; and wherein the synTF is inactive in the absence of the ligand for the cytosolic sequestering protein and the presence of the inhibitor for the NS3 protease.

48. The synTF of any of paragraphs 1-47, further comprising a linker peptide, wherein the linker peptide can be positioned anywhere from: between the DBD and the regulator protein; between the regulator protein and the effector domain; between the DBD and effector domain; within the DBD, effector domain, or regulator protein; or any combination thereof.

PGER, (SEQ ID NO: 340)

TGSQK, (SEQ ID NO: 341)

TGEKP, (SEQ ID NO: 342)

THLR, (SEQ ID NO: 343)

TGGGEKP, (SEQ ID NO: 344)

(SEQ ID NO: 345)
FHYDRNNIAVGADESVVKEAHREVINSSTEGLLLNIDKDIRKILSGYIVE
IEDTE;

VEIEDTE, (SEQ ID NO: 346)

KDIRKILSGYIVEIEDTE; (SEQ ID NO: 347)

STEGLLLNIDKDIRKILSGYIVEIEDTE, (SEQ ID NO: 348)

EVKQENRLLNESES; (SEQ ID NO: 349)

(SEQ ID NO: 350)
VGADESVVKEAHREVINSSTEGLLLNIDKDIRKILSGYIVEIEDTE;

GGSGG; (SEQ ID NO: 67)

GGGSG; (SEQ ID NO: 70)

CVRGS, (SEQ ID NO: 73)

GGGGSG, (SEQ ID NO: 75)

GGSGSGSAC, (SEQ ID NO: 100)

LEGGGGSGG, (SEQ ID NO: 103)

GGGSGGT, (SEQ ID NO: 104)

-continued

SGGGSGGSGSS;                                    (SEQ ID NO: 345)

PGAGSSGDIM                                      (SEQ ID NO: 88)

GSSGTGSGSGTS;                                   (SEQ ID NO: 90)

SGTS;                                           (SEQ ID NO: 277)

GSGS,                                           (SEQ ID NO: 278)

GGSGGS,                                         (SEQ ID NO: 303)
and

GSSGSS.                                         (SEQ ID NO: 323)

49. A system for controlling gene expression, comprising:
  a. at least one synthetic transcription factor (synTF) comprising at least one DNA binding domain (DBD), a transcriptional effector domain (ED), and at least one regulator protein (RP),
     wherein the ED is directly or indirectly coupled or linked to the DBD, and wherein the coupling is regulated by the at least one RP, or wherein the cellular localization of the ED linked to the DBD is regulated by the at least one RP,
     wherein the at least one RP is regulated by an RP inducer,
     wherein the DBD can bind to a target DNA binding motif (DBM) located upstream of a promoter operatively linked to a gene,
  b. a nucleic acid construct comprising:
     i. at least one target DNA binding motif (DBM) comprising a target nucleic acid for binding of the at least one DBD of the synTF, and
     ii. a promoter sequence located 3' of the at least one DBM, and
     iii. a gene of interest operatively linked to the promoter sequence, wherein for synTFs where the coupling of the ED to the DBD is regulated by the at least one RP;
        in the presence of the RP inducer, the coupling of the ED to the DBD of the synTF is maintained, enabling the ED to be in proximity to the promoter sequence when the DBD binds to the DNA binding motif (DBM), where the ED controls the expression of the gene of interest ("ED-on"), or
        in the absence of the RP inducer, the coupling of the ED to the DBD of the synTF is severed, preventing the ED from being in proximity to the promoter sequence when the DBD binds to the DNA binding motif (DBM), preventing gene expression of the gene of interest ("ED-off"), and
     wherein for synTFs where the cellular localization of the ED linked to the DBD is regulated by the at least one regulator protein;
        in the presence of the RP inducer, the ED coupled to the DBD of the synTF is not sequestered in the cytosol, enabling the DBD to bind to the DNA binding motif (DBM) and enabling the transcriptional effector domain (ED) to be in proximity to the promoter sequence to control the expression of the gene of interest ("ED-on"), or
        in the absence of the RP inducer, the ED coupled to the DBD of the synTF is sequestered in the cytosol, preventing the DBD of the synTF from binding to the DBM, and preventing the effector domain (ED) from being in proximity to the promoter sequence, preventing expression of the gene of interest ("ED-off").

50. The system of paragraph 49, wherein the transcriptional effector domain (ED) is a transcriptional activator (TA), wherein
  a. for synTFs where the coupling of the ED to the DBD is regulated by the at least one RP;
     i. in the presence of the RP inducer, the coupling of the ED to the DBD of the synTF is maintained, enabling the TA domain to be in proximity to the promoter sequence when the DBD binds to the DNA binding motif (DBM), where the TA turns on the expression of the gene of interest ("TA-on"), or
     ii. in the absence of the RP inducer, the coupling of the ED to the DBD of the synTF is severed, preventing the TA domain from being in proximity to the promoter sequence when the DBD binds to the DNA binding motif (DBM), preventing expression of the gene of interest ("TA-off"), and
  b. for synTFs where the cellular localization of the ED linked to the DBD is regulated by the at least one RP;
     i. in the presence of the RP inducer, the ED coupled to the DBD of the synTF is not sequestered in the cytosol, enabling the DBD to bind to the DNA binding motif (DBM) and enabling the TA domain to be in proximity to the promoter sequence to turn on expression of the gene of interest ("TA-on"), or
     ii. in the absence of the RP inducer, the ED coupled to the DBD of the synTF is sequestered in the cytosol, preventing the DBD from binding to the DBM, and preventing the TA domain from being in proximity to the promoter sequence, preventing expression of the gene of interest ("TA-off").

51. The system of paragraph 49, wherein the ED is a transcriptional repressor (TR), wherein
  a. for synTFs where the coupling of the ED to the DBD is regulated by the at least one regulator protein;
     i. in the presence of the RP inducer, the coupling of the ED to the DBD of the synTF is maintained, enabling the transcriptional repressor (TR) to be in proximity to the promoter sequence when the DBD binds to the DNA binding motif (DBM), where the TR prevents expression of the gene of interest ("TR-on" (no-expression), or
     ii. in the absence of the RP inducer, the coupling of the ED to the DBD of the synTF is severed, preventing the transcriptional repressor (TR) from being in proximity to the promoter sequence when the DBD binds to the DNA binding motif (DBM), allowing expression of the gene of interest ("TR-off" (yes-expression), and
  b. for synTFs where the cellular localization of the ED linked to the DBD is regulated by the at least one regulator protein;
     i. in the presence of the RP inducer, the ED coupled to the DBD of the synTF is not sequestered in the cytosol, enabling the DBD to bind to the DNA binding motif (DBM) and enabling the transcriptional repressor (TR) to be in proximity to the promoter sequence to turn off expression of the gene of interest ("TR-on" (no-expression), or ii. in the absence of the RP inducer, the ED coupled to the DBD of the synTF is sequestered in the cytosol, preventing the DBD from binding to the DBM, and preventing the transcriptional repressor (TR) from being in proximity to the promoter sequence, allowing expression of the gene of interest ("TR-off" yes-expression).

52. The system of any of paragraphs 49-51, wherein the synTF are selected from any of those in paragraphs 1-48.

53. The system of any of paragraph 49-52, wherein the at least one synTF further comprises a N-terminal or C-terminal Small molecule-Assisted Shutoff (SMASh) domain, wherein SMASh domain comprises a self-cleaving SMASh protease, a partial protease helical domain and a cofactor domain, wherein in the presence of an inhibitor to the SMASh protease, the SMASh protease activity is inhibited, resulting in the synTF being degraded and preventing the DBD of the synTF binding to the DBM and controlling the expression or repression of the gene of interest ("synTF-degradation"; TA-off (no expression), TR-off (yes-expression)), wherein in the absence of an inhibitor to the SMASh protease, the SMASh protease is active and self cleaves/uncouples from the synTF, resulting the SMASh domain being targeted for degradation and allowing the DBD of the synTF to bind to the DBM and the ED of synTF to control the expression of the gene of interest ("SMASh-degradation, TA-on (yes-expression), TR-on (no-expression)).

54. The system of any of paragraphs 49-53, wherein the promoter is selected from any of: miniCMV promoter, miniTK promoter, ybTATA promoter, minSV40 promoter, CMV53 promoter, pJB42CAT5 promoter, MLP promoter, TATA promoter, pSFFV promoter, CMV promoter, pUb/UbC promoter, EF1a promoter, PGK/pGK promoter, CAG/CAGG promoter, SV40 promoter, and beta actin/ACTB promoter.

55. A cell comprising
   a. a first nucleic acid sequence comprising at least one target DNA binding motif (DBM) comprising a target nucleic acid for binding of the at least one DBD of a synTF, a promoter sequence located 3' of the at least one DBM, and a nucleic acid encoding a gene of interest (GOI) operatively linked to the promoter sequence, and
   b. a second nucleic acid sequence comprising a nucleic acid encoding a synthetic transcription factor (synTF) according to paragraphs 1-48, operatively linked to an inducible or constitutive promoter.

56. The cell of paragraph 55, wherein the cell comprises a nucleic acid construct comprising in the 5' to 3' direction:
   a. a nucleic acid sequence encoding a gene of interest (GOI) in the inverse orientation,
   b. a first promoter sequence in the inverse orientation and operatively linked to the nucleic acid encoding the GOI,
   c. a nucleic acid sequence comprising at least one target DNA binding motif (DBM) comprising a target nucleic acid for binding of the at least one DBD of a synTF, wherein binding of the DBD of the synTF places the effector domain (ED) in the proximity of the promoter sequence operatively linked to the GOI,
   d. a second promoter sequence, and
   e. a nucleic acid sequence encoding the synthetic transcription factor (synTF), operatively linked to the second promoter sequence, wherein the encoded synTF comprises at least one DBD that binds to the at least DBM of the nucleic acid sequence of (c).

57. The cell of paragraph 55 or 56, wherein the promoter sequence operatively linked to the GOI is selected from any of: miniCMV promoter, miniTK promoter, ybTATA promoter, minSV40 promoter, CMV53 promoter, pJB42CAT5 promoter, MLP promoter, and TATA promoter.

58. The cell of paragraph 55 or 56, wherein the promoter sequence operatively linked to the nucleic acid encoding the synTF is a pSFFV promoter, CMV promoter, pUb/UbC promoter, EF1a promoter, PGK/pGK promoter, CAG/CAGG promoter, SV40 promoter, and beta actin/ACTB promoter.

59. A polynucleotide encoding the synTF of any one of paragraphs 1-48, or the synTF system of any one of paragraphs 49-54.

60. A vector comprising the polynucleotide of paragraph 59.

61. A composition comprising the synTF of any one of paragraphs 1-48, the synTF system of any one of paragraphs 49-54, the synTF cell of any one of paragraphs 55-58, a polynucleotide of paragraph 59, or the vector of paragraph 60.

62. A pharmaceutical composition comprising the synTF of any one of paragraphs 1-48, the synTF system of any one of paragraphs 49-54, the synTF cell of any one of paragraphs 55-58, a polynucleotide of paragraph 59, or the vector of paragraph 60, and a pharmaceutically acceptable carrier.

63. A method of regulating the activity of a synTF, comprising the steps of:
   a. providing a population of cells of any one of paragraphs 55-58; and
   b. contacting the population of cells with an effective amount of a regulator protein inducer.

64. A method of regulating the expression of a gene of interest, comprising the steps of:
   a. providing a population of cells of any one of paragraphs 55-58; and
   b. contacting the population of cells with an effective amount of a regulator protein inducer.

65. A method of treating a subject in need of a cell-based therapy, comprising the steps of:
   a. administering to the subject a population of cells of any one of paragraphs 55-58; and
   b. administering to the subject an effective amount of a regulator protein inducer.

66. The method of any one of paragraphs 63-65, wherein the population of cells comprises immune cells.

67. The method of paragraph 65, wherein the population of immune cells comprises CD4+ T cells, CD8+ T cells, Tregs, or NK cells.

68. The method of any one of paragraphs 65-67, wherein the regulator protein inducer is administered at the same time the population of cells is administered.

69. The method of any one of paragraphs 65-67, wherein the regulator protein inducer is administered after the population of cells is administered.

EXAMPLES

Example 1: Inducible Synthetic Transcription Factors (NS3 SynTFs)

Overview

Described herein are synthetic transcription factors (synTFs) and responsive promoters for precise, human genome-orthogonal regulation. Synthetic transcription factor proteins are minimal, modular fusions of DNA binding and effector domains that together can locally regulate the expression of genes at responsive promoters. They fundamentally couple engineered zinc finger (ZF) DNA binding arrays to transcriptional or epigenetic effector domains.

The engineered ZF arrays described herein are derived from native mammalian ZF scaffolds but re-designed to target specific 18-20 nucleotide sequences that are distant from human genome sequences; this feature confers reduced off-target binding potential in the human genome.

The transcriptional and epigenetic effector domains include naturally-occurring human effector domains such as the p65 transcriptional activator and KRAB repressor. When coupled with engineered ZF arrays, they can locally regulate transcription at targeted loci in engineered cells (i.e. activating or repressing downstream genes).

Corresponding responsive promoters are designed by placing instances of ZF binding sites upstream of constitutive promoters to enable precise and local gene expression control in mammalian cells.

Described herein is a library of synthetic transcription factors that strongly regulate gene expression at their corresponding responsive promoters and minimally impact the expression of off-target genes in the human genome (see e.g., FIG. 1A-1H).

In the absence of a small molecule, the synthetic transcription factor is rendered inactive. In the presence of a cognate small molecule, the transcription factor can regulate expression of an output gene from a responsive promoter (see e.g., FIG. 2A-2B).

Induced Proximity Domains

ABI/PYL induced proximity domains that are responsive to a small molecule (abscisic acid=ABA) can be used to regulate a synTF as described herein (see e.g., Liang et al. Sci Signal, 2011). The ABA-insensitive 1 (ABI1) and PYR1-like (PYL) domains originating form *Arabidopsis thaliana* have complementary surfaces that can conditionally interact when coordinated by the small molecule abscisic acid (ABA). ABA is a plant hormone that is naturally present at low levels within the human diet, and is subsequently presumed to be a safe small molecule for human administration.

The expression of two fusion proteins—one with the ZF DNA binding domain fused to the ABI1 (or PYL) domain and one with the effector domain fused to the PYL (or ABI1) domain—permit separation of the synTF sub-domains, thereby rendering the local gene regulation functionality inactive.

Figures 3, 4:
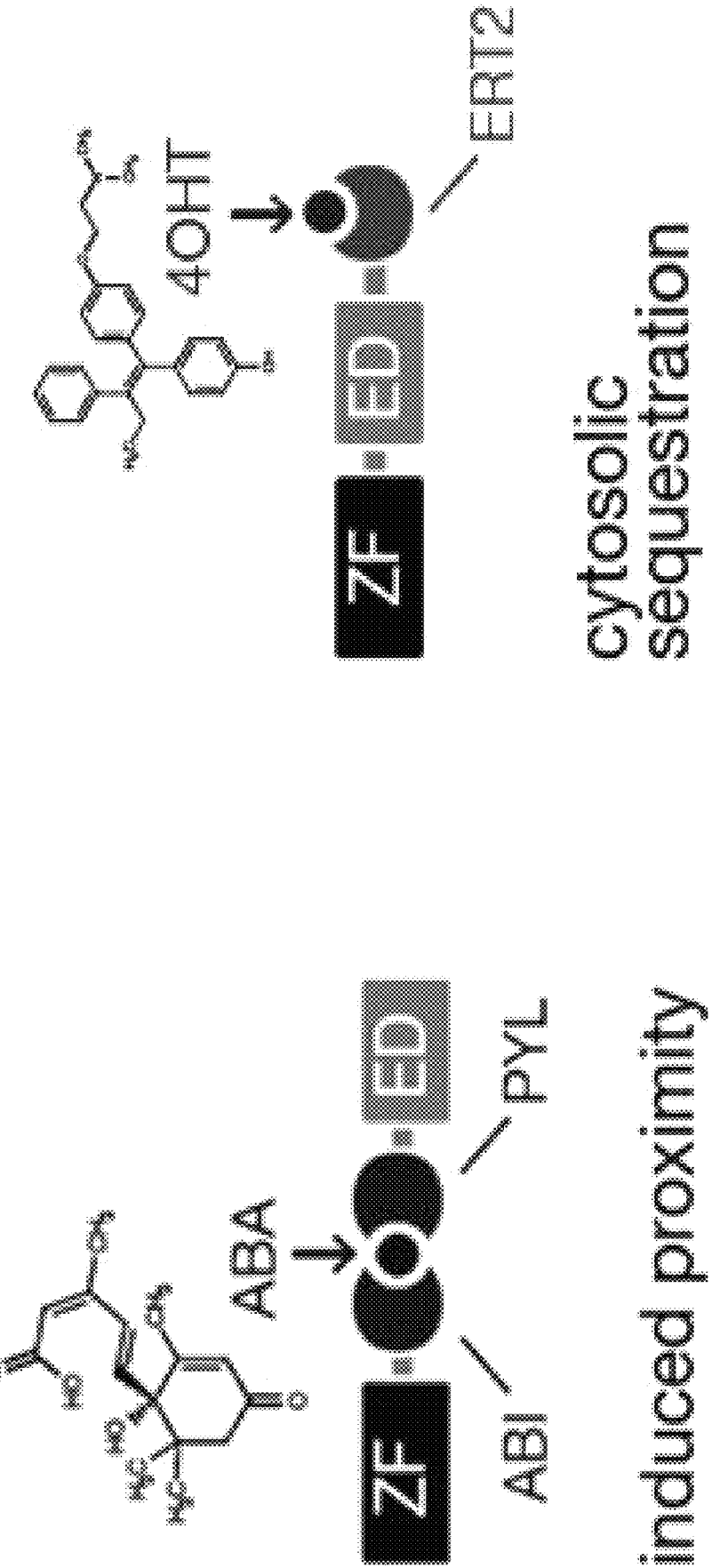
FIG. 3 is a schematic showing an exemplary synTF regulated by induced proximity.
FIG. 4 is a schematic showing an exemplary synTF regulated by cytosolic sequestration.

Subsequently, the administration of ABA can allow conditional dimerization between the ABI1 and PYL subunits, allowing the ZF and effector domains to remain locally coupled and retaining synTF functionality (see e.g., FIG. 3).

Translocation Domain

ERT2 nuclear translocation domain, which is responsive to a small molecule (4-hydroxytamoxifen=4OHT), can be used to regulate a synTF as described herein (see e.g., Indra et al. Nucleic Acids Res (1999)). The human estrogen receptor (ER) contains a ligand responsive domain that, when fused to other protein domains, can yield ligand-dependent control over activity. The domain naturally associates with cytoplasmic factors in the cell in the absence of cognate ligands, effectively sequestering itself in the cytoplasm. Binding of cognate ligands, such as estrogen or other steroid hormone derivatives, cause a conformational change to the receptor that allow dissociation from the cytoplasmic complexes and expose a nuclear localization signal, permitting translocation into the nucleus. A mutated variant of this estrogen receptor ligand binding domain (ERT2) has enhanced sensitivity to certain "orthogonal" ligands (e.g. tamoxifen, 4-hydroxytamoxifen) and decreased sensitivity to endogenous ligands (e.g. estradiol).

4-hydroxytamoxifen (4OHT) is a selective modulator of the estrogen receptor that has been FDA-approved as a treatment for certain breast cancers.

The expression of a fusion protein containing the ZF DNA binding domain, effector domain, and ERT2 domain permits cytoplasmic localization of the synTF, thereby rendering the local gene regulation functionally inactive, as the gene expression cassette resides in the nucleus/genome.

Subsequently, the administration of 4OHT can allow conditional nuclear translocation of the synTF, allowing synTF functionality in the cellular nucleus (see e.g., FIG. 4).

Self-Cleaving Protease Domain

Non-structural protein 3 (NS3) domain can be used for small molecule regulated control over synTF activity (see e.g., Lin et al. PNAS (2008)). The non-structural protein 3 (NS3) is a serine protease originating from the hepatitis C virus and is naturally capable of self-excision from expressed proteins. As such, the development of an expressed fusion protein with the NS3 protein domain placed between the ZF and effector domains permits auto-cleavage and separation of the synTF sub-domains, thereby rendering the local gene regulation functionality inactive.

Many FDA-approved small molecules have been developed to target the NS3 protease and inhibit its cleavage activity as HepC therapeutic intervention strategies.

Subsequently, the administration of one of these small molecules—e.g. grazoprevir—can prevent self-excision of NS3 from the fusion protein, allowing the ZF and effector domains to remain locally coupled and retaining synTF functionality.

In the absence of a small molecule, the NS3 protease self-excises from the expressed fusion protein, rendering the synthetic transcription factor inactive through the separation of the DNA binding and effector domains. In the presence of a small molecule, the NS3 protease activity is inhibited and the fusion protein complex is stabilized, permitting the transcription factor to regulate expression of an output gene from a responsive promoter (see e.g., FIG. 5A-5C).

Induced Degradation Domain

SMASh (Small Molecule-Assisted Shutoff) domain, which contains NS3 domain, can be used for small molecule regulated control over synTF activity. The small molecule-assisted shutoff (SMASh) tag is an engineered protein domain containing: the NS3 protease, a partial NS3 helicase domain, and a NS4A domain. All of the individual elements are derived from the hepatitis C virus.

The combined arrangement of the NS3 protease with the partial NS3 helicase and NS4A domain led to a "degron" sequence, facilitating rapid degradation of the domain (see e.g., Chung et al. Nat Chem Biol 2015).

The fusion of the SMASh domain to either the N- or C-terminus of a protein of interest results in its auto-cleavage and its separation from the protein, rendering the protein of interest expressed while the SMASh domain targeted for degradation.

Subsequently, the administration of an NS3 inhibitor small molecule, e.g., grazoprevir, can prevent self-excision of the SMASh from the protein of interest, rendering the entire fusion protein targeted for degradation and thus the protein of interest is not expressed.

The N53-containing SMASh protein has been used herein to post-translationally regulate activity of a synthetic transcription factor (see e.g., FIG. 6A-6B).

Experimental Assays and Supporting Data

Figure 7A:
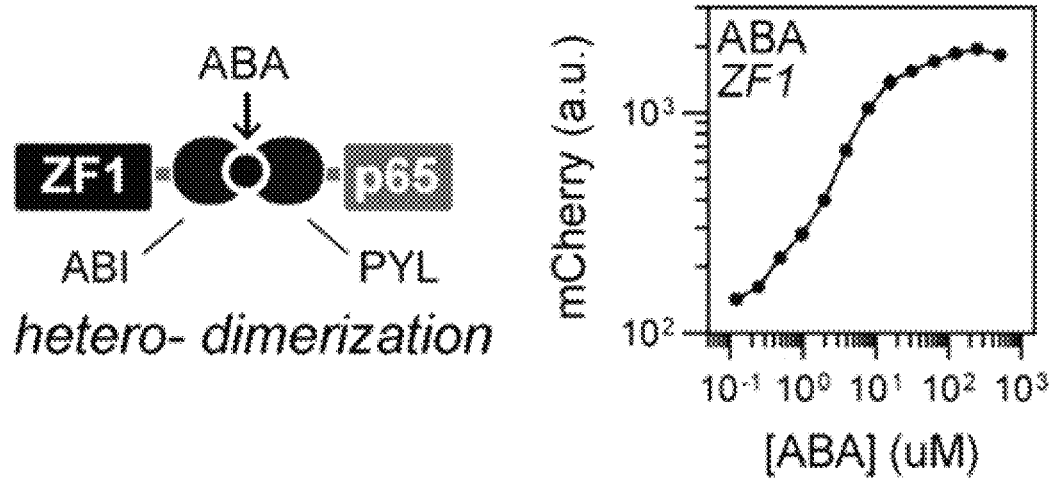
FIG. 7A-7C is a series of schematics showing an exemplary heterodimerization synTF and graphs showing that administration of a small molecule (ABA) led to temporal activation of a fluorescent protein output from a ZF-responsive promoter in Jurkat cell lines.
Figure 7B:
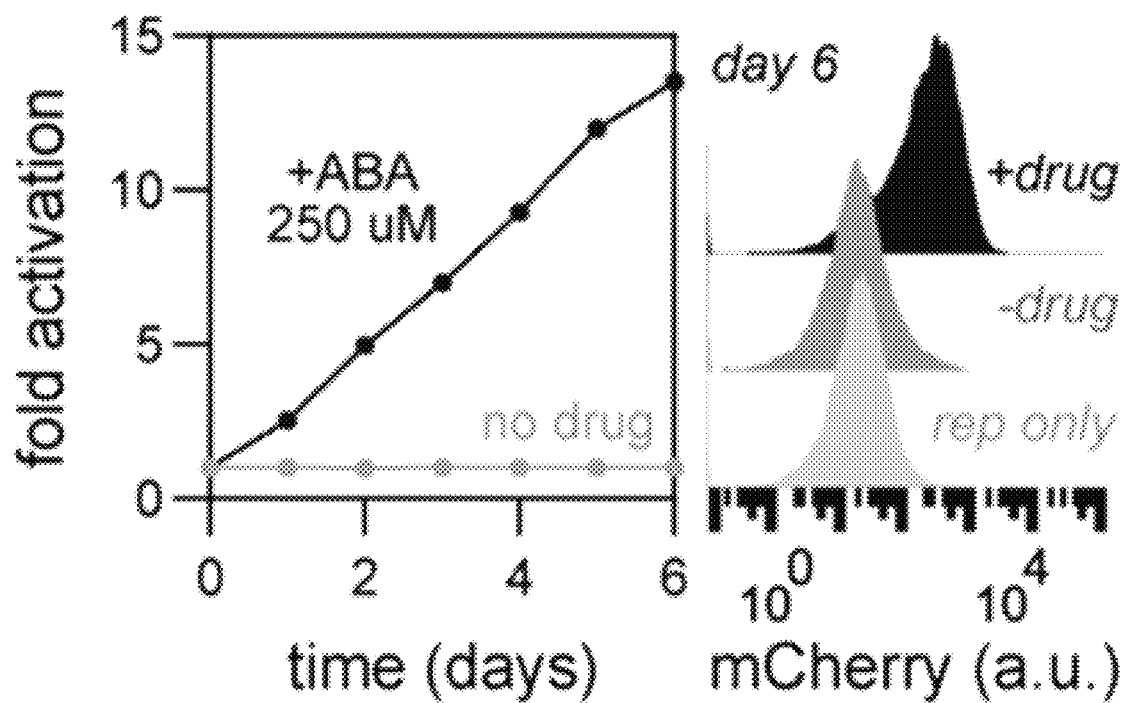
Figure 7C:
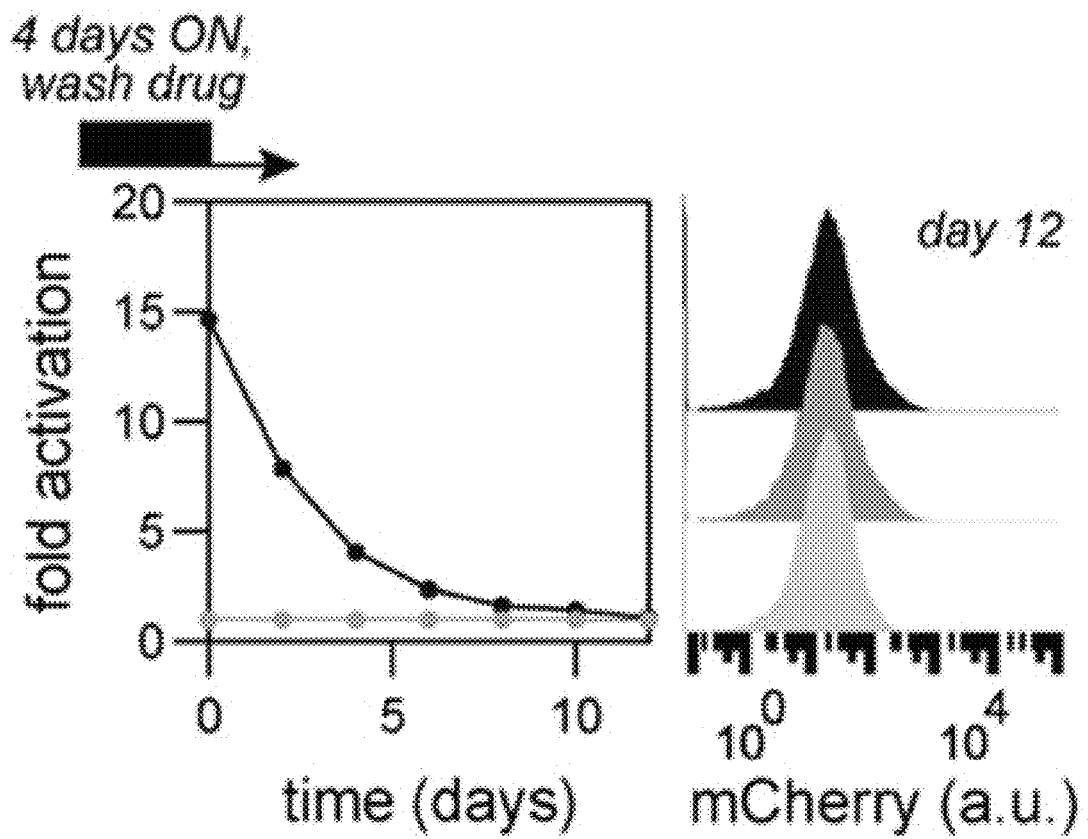

Dose- and time-inducible synthetic transcriptional activation of a fluorescent protein in human cell lines using ABI/PYL domains: Administration of a small molecule (ABA) led to temporal activation of a fluorescent protein output from a ZF-responsive promoter in Jurkat cell lines. Output fluorescence was measured as a function of several different ABA treatment concentrations as indicated (dose response; see e.g., FIG. 7A). Administration of a small molecule (ABA) led to temporal activation of a fluorescent protein output from a ZF-responsive promoter in Jurkat cell lines. This level of expression was compared to an untreated cell line which did not activate output expression (see e.g., FIG. 7B). Removal of a small molecule (ABA) after four days led to temporal de-activation of a fluorescent protein output from a ZF-responsive promoter in Jurkat cell lines. This level of expression was compared to an untreated cell line which did not activate output expression (see e.g., FIG. 7C).

Figure 8A:
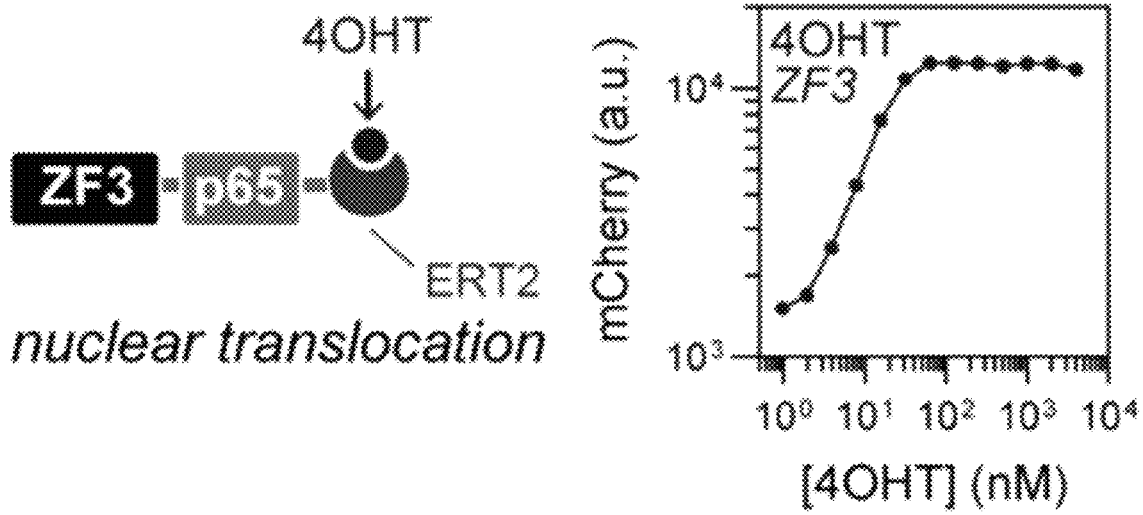
FIG. 8A-8C is a series of schematics showing an exemplary cytosolic sequestering synTF and graphs showing that administration of a small molecule (4OHT) led to temporal activation of a fluorescent protein output from a ZF-responsive promoter in Jurkat cell lines.
Figure 8B:
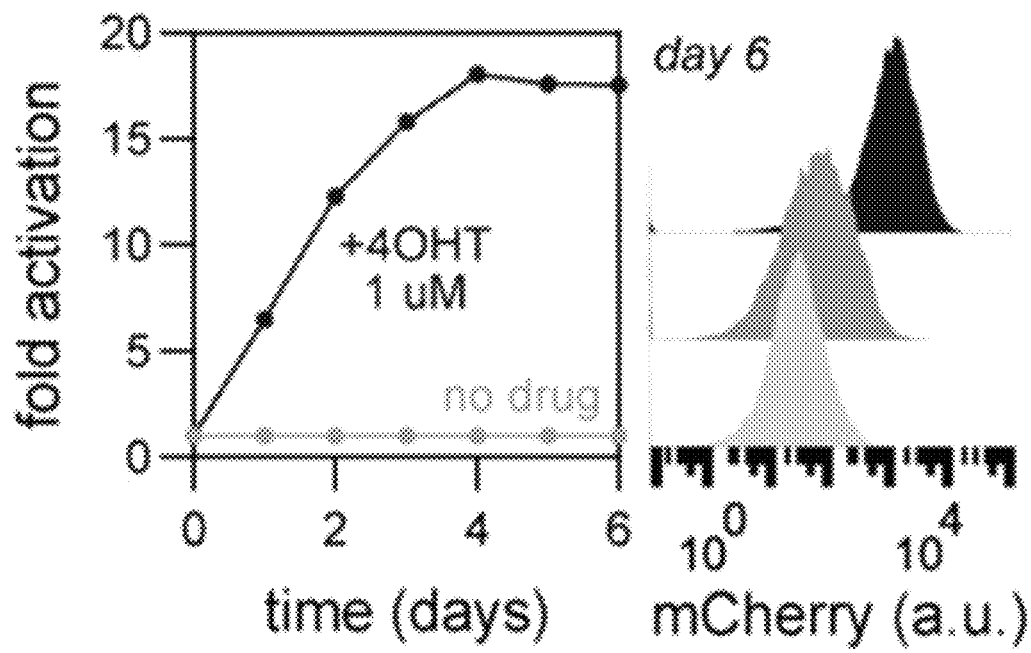
Figure 8C:
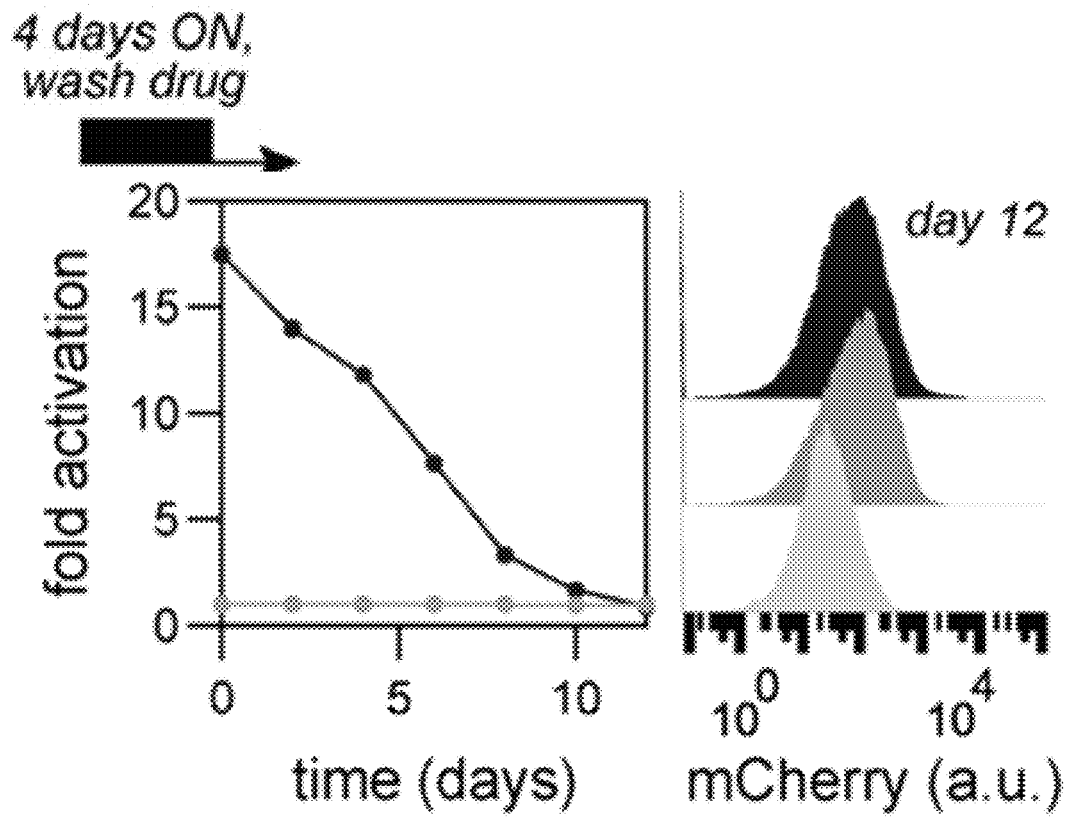

Dose- and time-inducible synthetic transcriptional activation of a fluorescent protein in human cell lines using ERT2 domain: Administration of a small molecule (4OHT) led to temporal activation of a fluorescent protein output from a ZF-responsive promoter in Jurkat cell lines. Output fluorescence was measured as a function of several different 4OHT treatment concentrations as indicated (dose response; see e.g., FIG. 8A). Administration of a small molecule (4OHT) led to temporal activation of a fluorescent protein output from a ZF-responsive promoter in Jurkat cell lines. This level of expression was compared to an untreated cell line which did not activate output expression (see e.g., FIG. 8B). Removal of a small molecule (4OHT) after four days led to temporal de-activation of a fluorescent protein output from a ZF-responsive promoter in Jurkat cell lines. This level of expression was compared to an untreated cell line which did not activate output expression (see e.g., FIG. 8C).

Dose- and time-inducible synthetic transcriptional activation of a fluorescent protein in human cell line using NS3: Administration of a small molecule (grazoprevir) led to temporal activation of a fluorescent protein output from a ZF-responsive promoter in Jurkat cell lines. Output fluorescence was measured as a function of several different grazoprevir treatment concentrations as indicated (dose response) (see e.g., FIG. 9A). Administration of a small molecule (grazoprevir) led to temporal activation of a fluorescent protein output from a ZF-responsive promoter in Jurkat cell lines (see e.g., FIG. 9B). This level of expression was compared to an untreated cell line which did not activate output expression. Removal of a small molecule (grazoprevir) after four days led to temporal de-activation of a fluorescent protein output from a ZF-responsive promoter in Jurkat cell lines. This level of expression was compared to an untreated cell line which did not activate output expression (see e.g., FIG. 9C).

Administration of a small molecule (e.g., ABA, 4OHT, or grazoprevir) led to temporal activation of a fluorescent protein output from a ZF-responsive promoter in both HEK293 and Jurkat cell lines (see e.g., FIG. 10A-10D). This enhanced level of expression was compared to an untreated cell line which did not activate output expression. Output fluorescence as a function of several different small molecule (e.g., ABA, 4OHT, or grazoprevir) treatment concentrations is also indicated here.

Figure 11A:
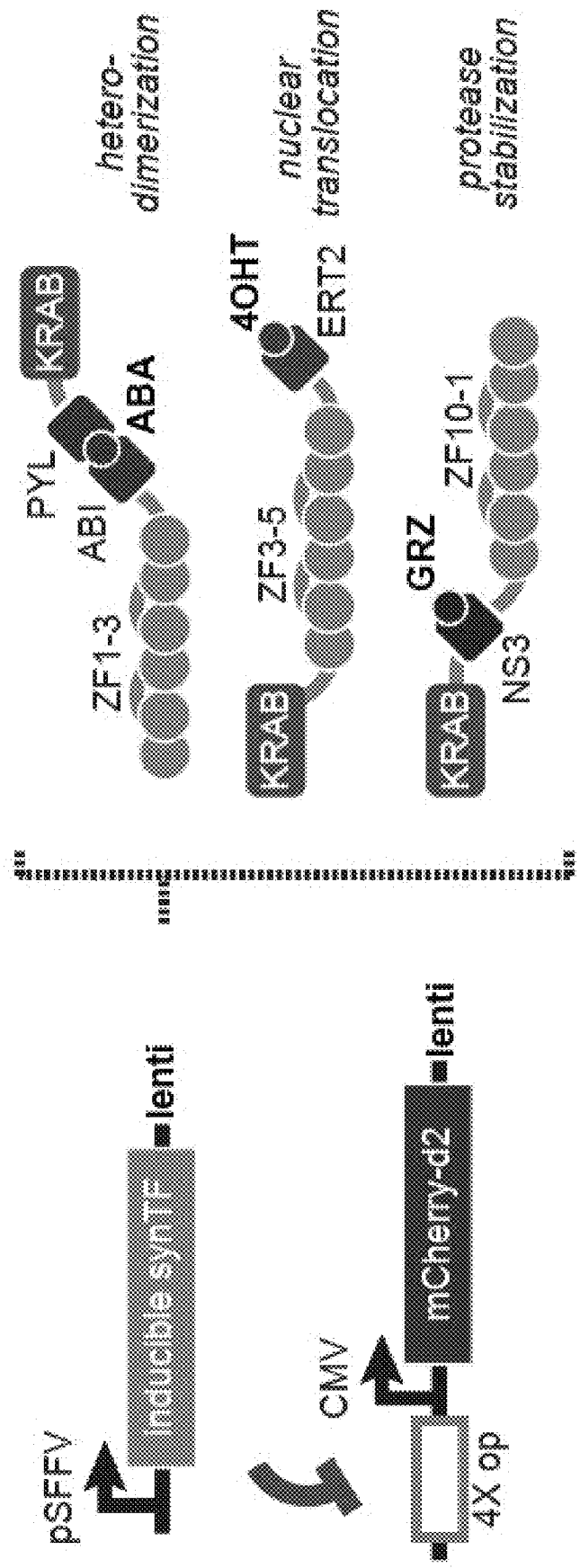
FIG. 11A-11B is a series of schematics and graphs showing inducible synthetic transcriptional repression of a fluorescent protein in human cell lines.
Figure 11B:
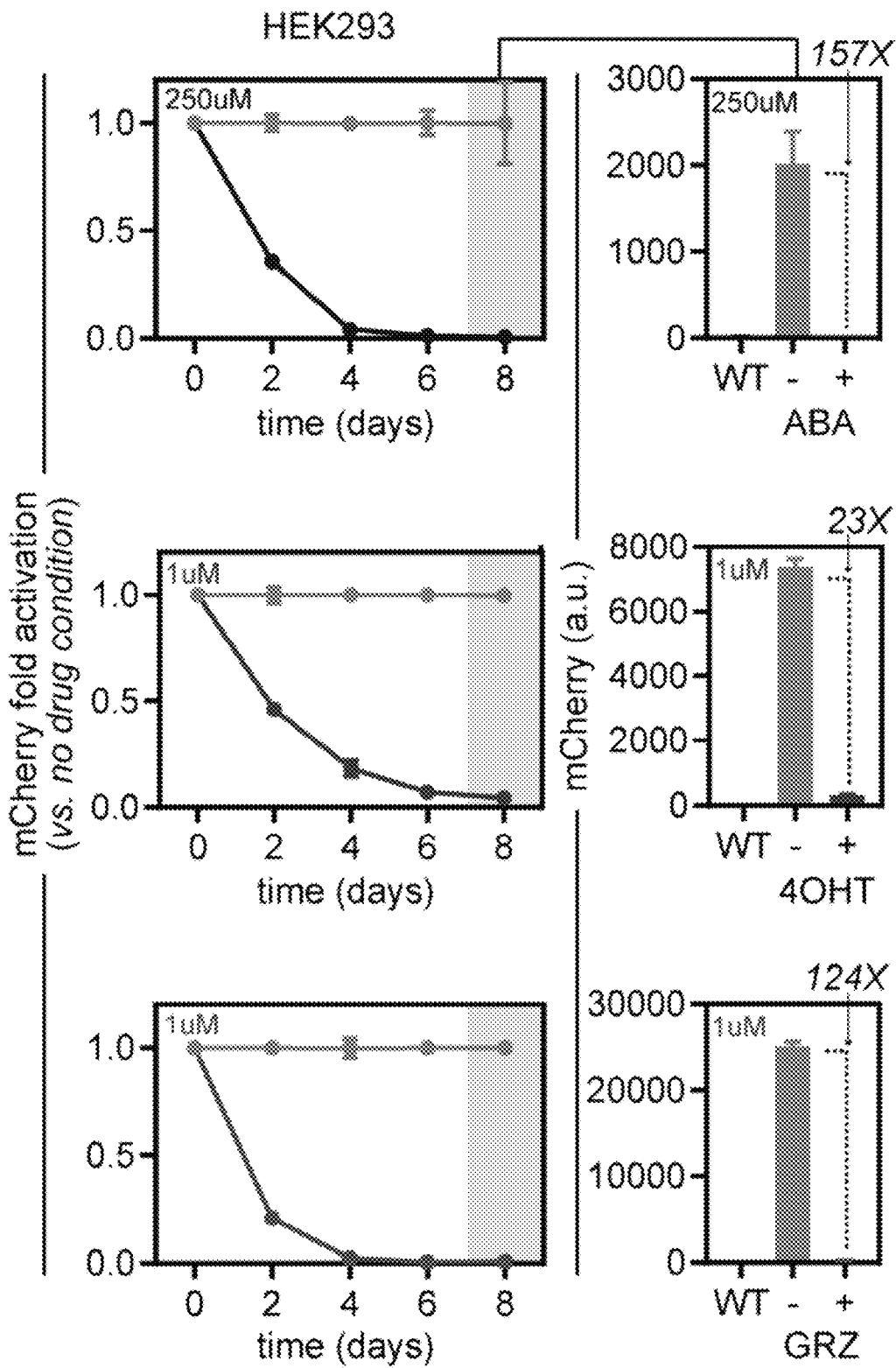

Inducible synthetic transcriptional repression of a fluorescent protein in human cell lines: Administration of a small molecule (ABA) led to temporal silencing of a fluorescent protein output from a ZF-responsive promoter in HEK293 cell lines. This decreased level of expression was compared to an untreated cell line which did not silence output expression (see e.g., FIG. 11B, top graph). Administration of a small molecule (4OHT) led to temporal silencing of a fluorescent protein output from a ZF-responsive promoter in HEK293 cell lines. This decreased level of expression was compared to an untreated cell line which does not silence output expression (see e.g., FIG. 11B, middle graph). Administration of a small molecule (GRZ) led to temporal silencing of a fluorescent protein output from a ZF-responsive promoter in HEK293 cell lines. This decreased level of expression was compared to an untreated cell line which does not silence output expression (see e.g., FIG. 11B, bottom graph).

Figure 12B:
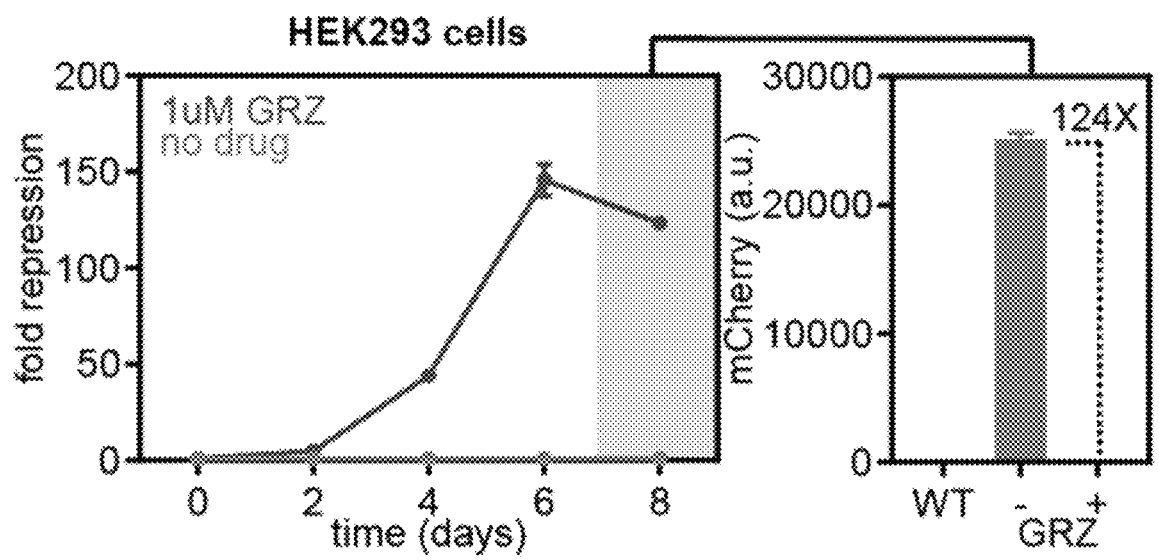
Figure 12C:
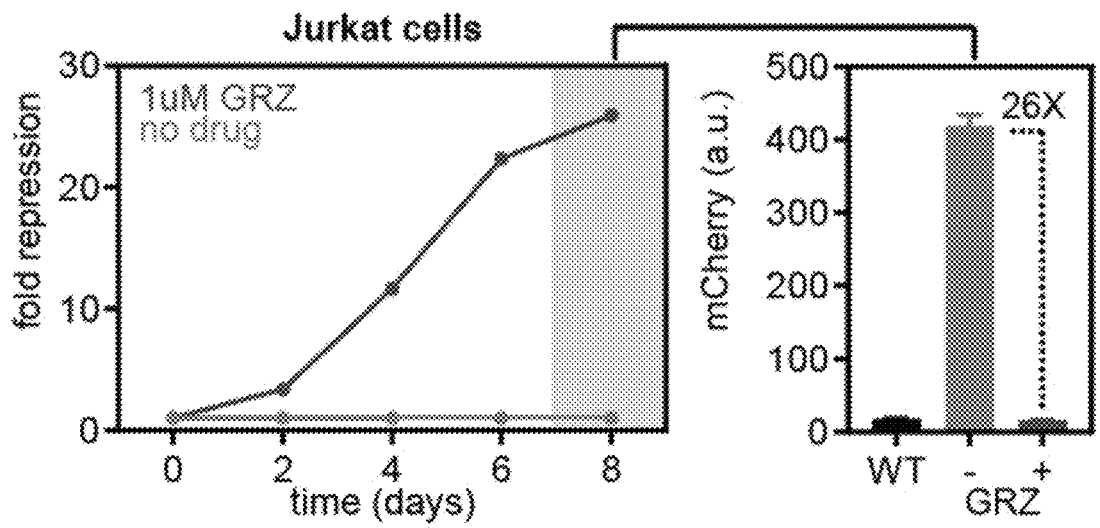
Figure 13A:
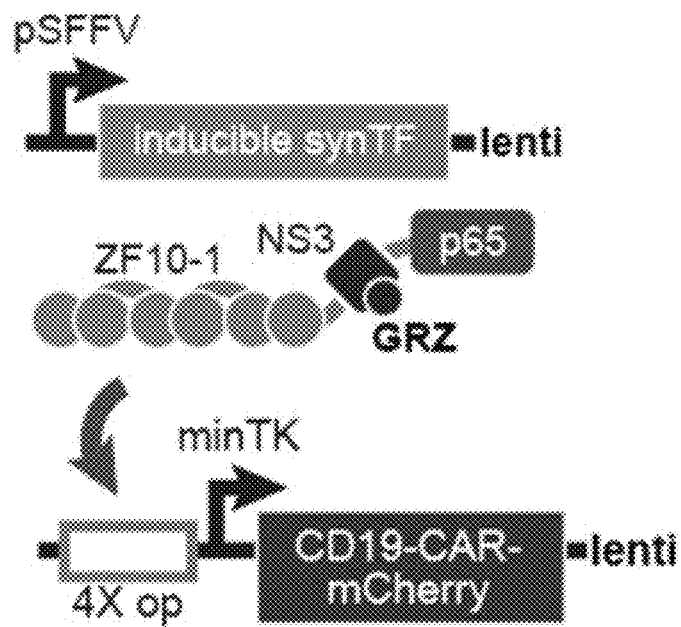
FIG. 13A-13D is a series of schematics and graphs showing that administration of a small molecule (grazoprevir) led to temporal activation of a fluorescently-tagged chimeric antigen receptor (CD19-CAR) protein from a ZF-responsive promoter in CD4+ primary human T cells.
Figure 13B:
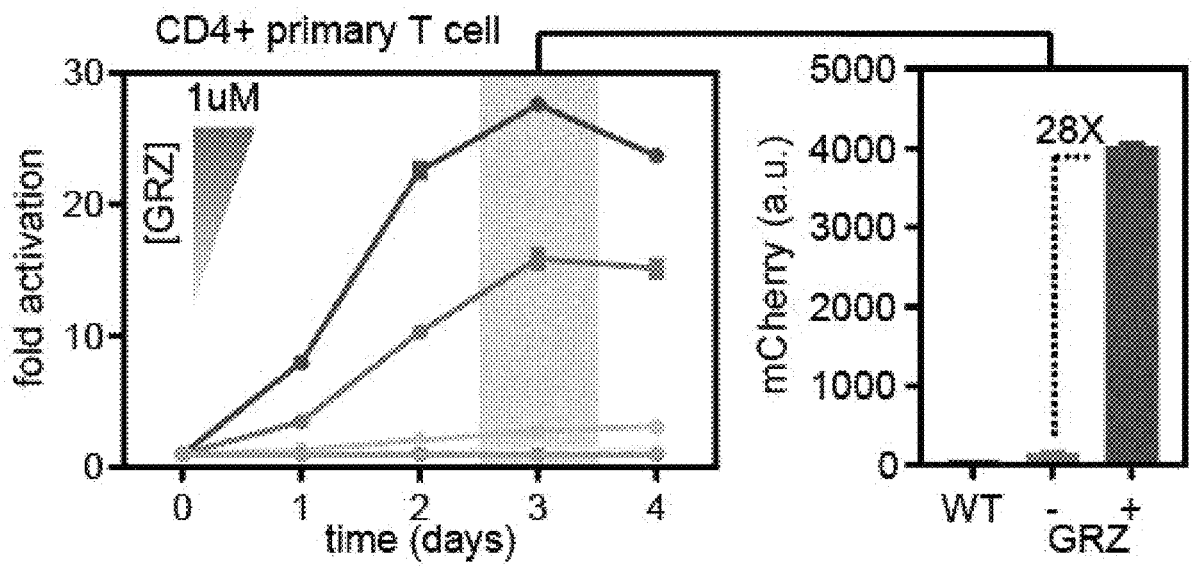
Figure 13C:
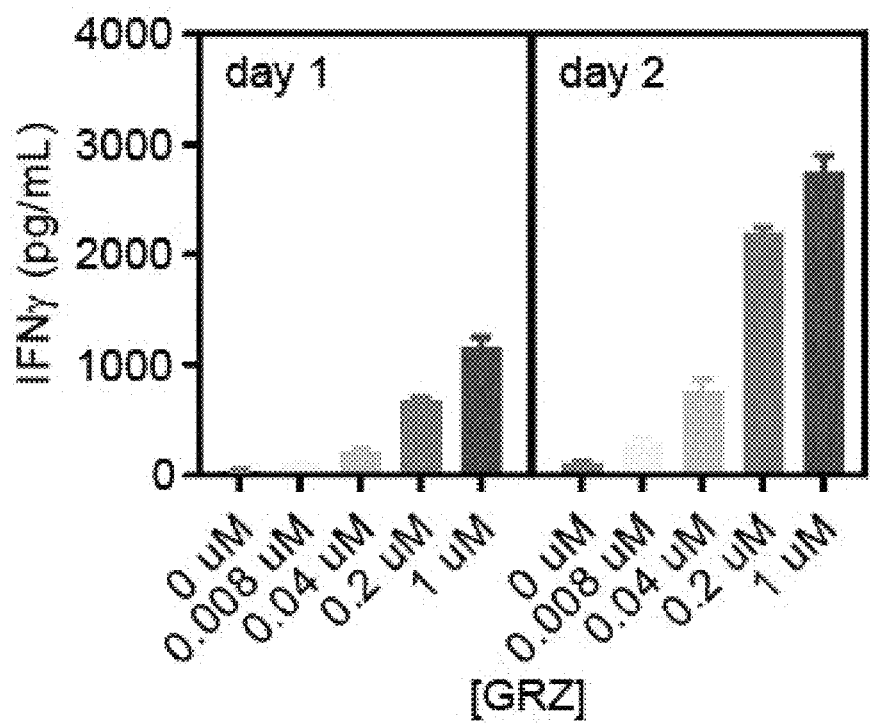
Figure 13D:
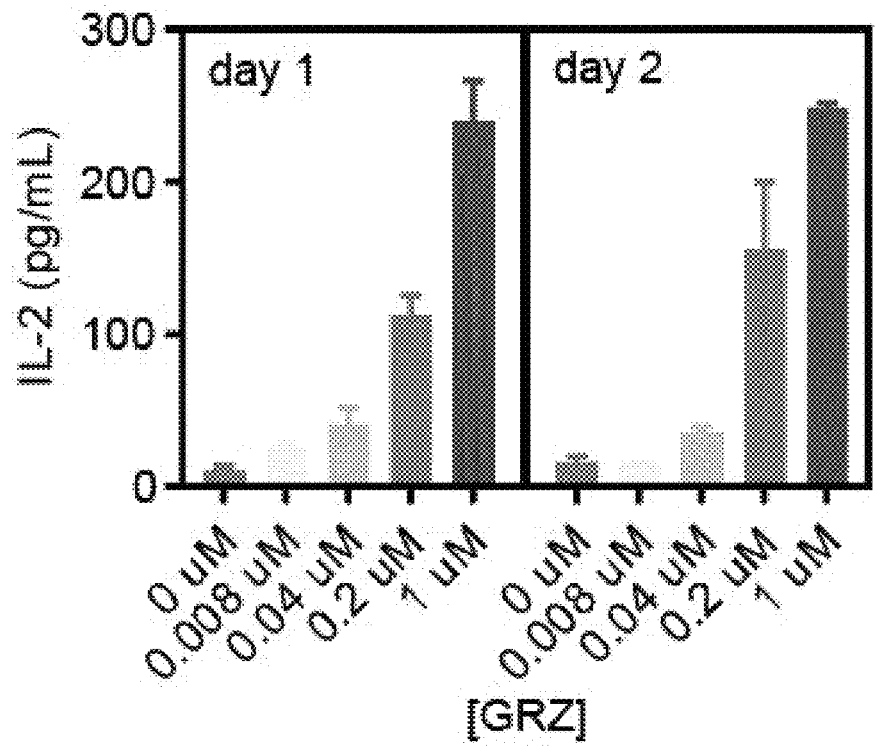

Inducible synthetic transcriptional repression of a fluorescent protein in human cell lines: Administration of a small molecule (grazoprevir) led to temporal silencing of a fluorescent protein output from a ZF-responsive promoter in HEK293 and Jurkat cell lines. This decreased level of expression was compared to an untreated cell line which did not silence output expression (see e.g., FIG. 12A-12C).

Inducible synthetic transcriptional activation of a Chimeric Antigen Receptor in primary human cells: Administration of a small molecule (grazoprevir) led to temporal activation of a fluorescently-tagged chimeric antigen receptor (CD19-CAR) protein from a ZF-responsive promoter in CD4+ primary human T cells. This enhanced level of expression was compared to an untreated cell line which did not activate output expression. Output fluorescence as a function of several different grazoprevir treatment concentrations is also indicated here. Subsequent co-culture of these primary cells with CD19 antigen-presenting target cells resulted in T-cell activation, measured by enhanced production of cytokines. This enhanced level of cytokine production was compared to an untreated cell line which did not activate cytokine expression. Cytokine production as a function of several different grazoprevir treatment concentrations is also indicated here (see e.g., FIG. 13A-13D).

Inducible synthetic transcriptional activation of a Chimeric Antigen Receptor (in dual-drug regulated context) in primary human cells: Administration of a small molecule (4OHT) led to expression and secretion of IL4 cytokine from a ZF-responsive promoter in CD4+ primary human T cells. This system was used in conjunction with another small molecule (grazoprevir) regulated activation of a fluorescently-tagged chimeric antigen receptor (CD19-CAR) protein from an orthogonal ZF-responsive promoter. The ERT2-synTF was only responsive to 4OHT and was unaffected by the presence of grazoprevir. Likewise, the NS3-synTF was only responsive to grazoprevir and was unaffected by the presence of 4OHT. (see e.g., FIG. 14A-14B).

Inducible synthetic transcriptional activation of a Cytokine in Jurkat human cell lines: Administration of a small molecule (grazoprevir) led to temporal activation of a cytokine (IL10) from a ZF-responsive promoter in Jurkat T cell lines. This enhanced level of expression was compared to an untreated cell line which did not activate output expression. This inducible activation can be achieved through the delivery of separate lentiviral cassettes for NS3-synTF expression and IL10 production ("double lentiviral vector"), or through the delivery of a single lentiviral cassette expressing the NS3-synTF as well as regulating IL10 production (see e.g., FIG. 15A-15C).

Figure 16A:
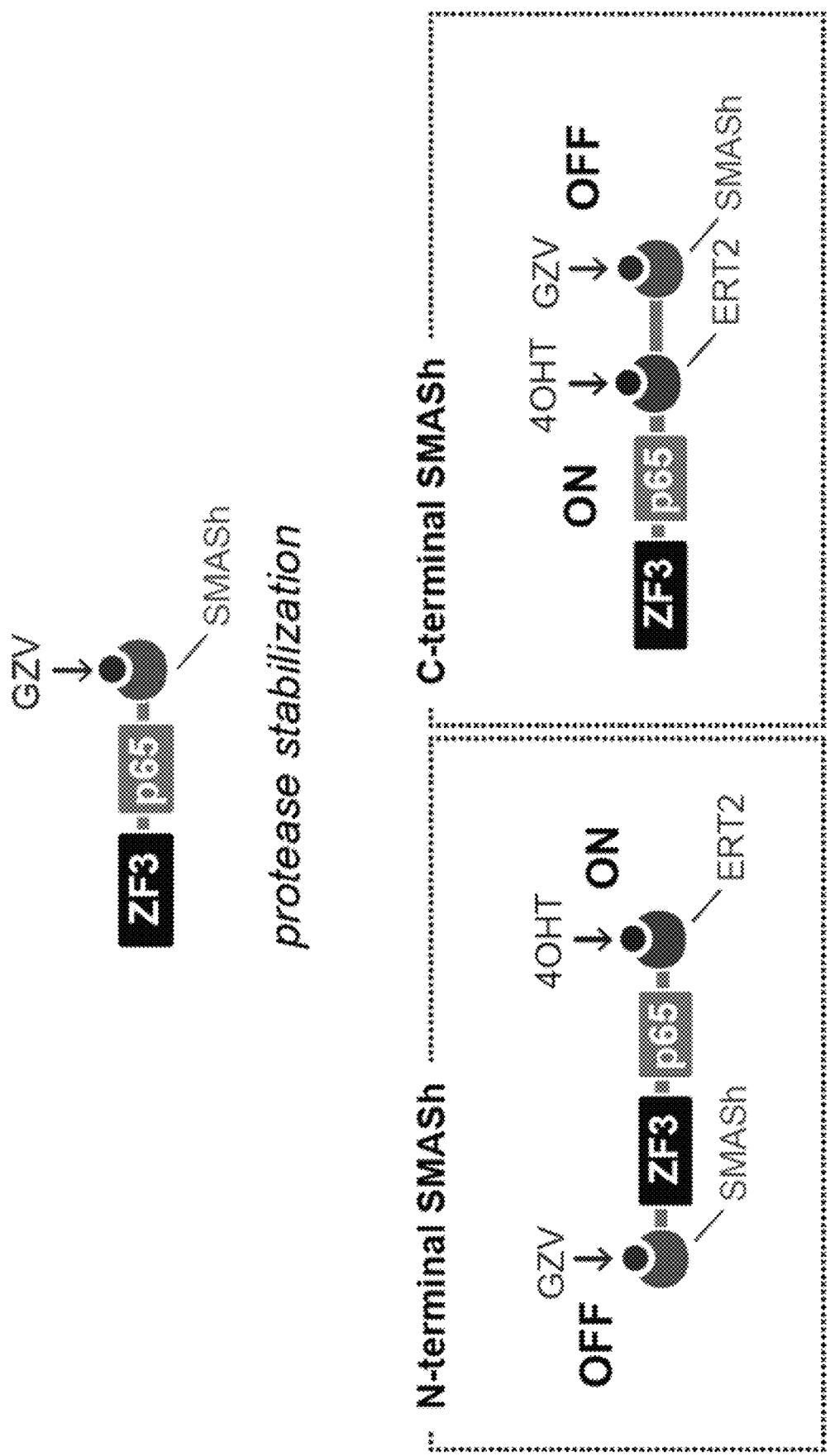
FIG. 16A-16B is a series of schematics and graphs showing inducible synthetic transcriptional activation and tunable deactivation of a fluorescent protein in human cell lines using a cytosolic sequestering and induced degradation synTF comprising ERT2 and SMASh domains, respectively.
Figure 16B:
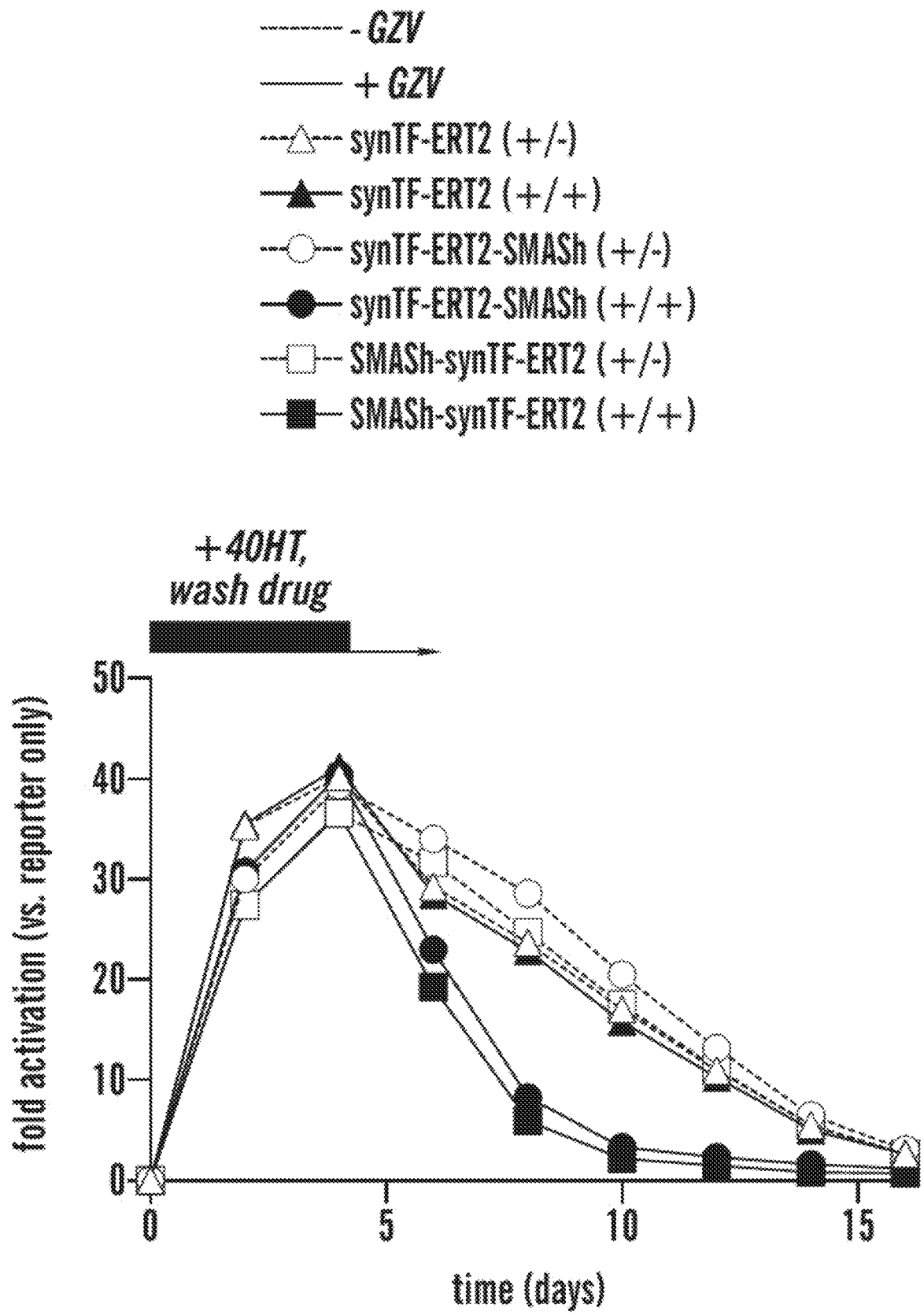

Inducible synthetic transcriptional activation and tunable deactivation of a fluorescent protein in human cell lines using ERT2 and SMASh domains: Three Jurkat T cell lines were tested: (1) ZF-p65-ERT2 (no SMASh, see e.g., FIG. 4); (2) ZF-p65-ERT2-SMASh (C-terminal SMASh); and (3) SMASh-ZF-p65-ERT2 (N-terminal SMASh) (see e.g., FIG. 16A). Administration of an ERT2-responsive small molecule (4OHT) for 4 days led to temporal activation of a fluorescent protein from a ZF-responsive promoter in all cell lines. Subsequent removal of a small molecule (4OHT) from days 6-16 led to temporal deactivation of the fluorescent protein in all cell lines. Absence of a SMASh-responsive small molecule (grazoprevir) for 12 days led to equivalent, slow deactivation of the reporter to baseline levels. Administration of a SMASh-responsive small molecule (grazoprevir) for 12 days leads to fast deactivation of the reporter to the baseline levels. This rapid deactivation of the reporter was compared to the condition lacking the SMASh domain, which led to equivalent slow deactivation as in the "absence of grazoprevir" condition (see e.g., FIG. 16B).

Figure 17:
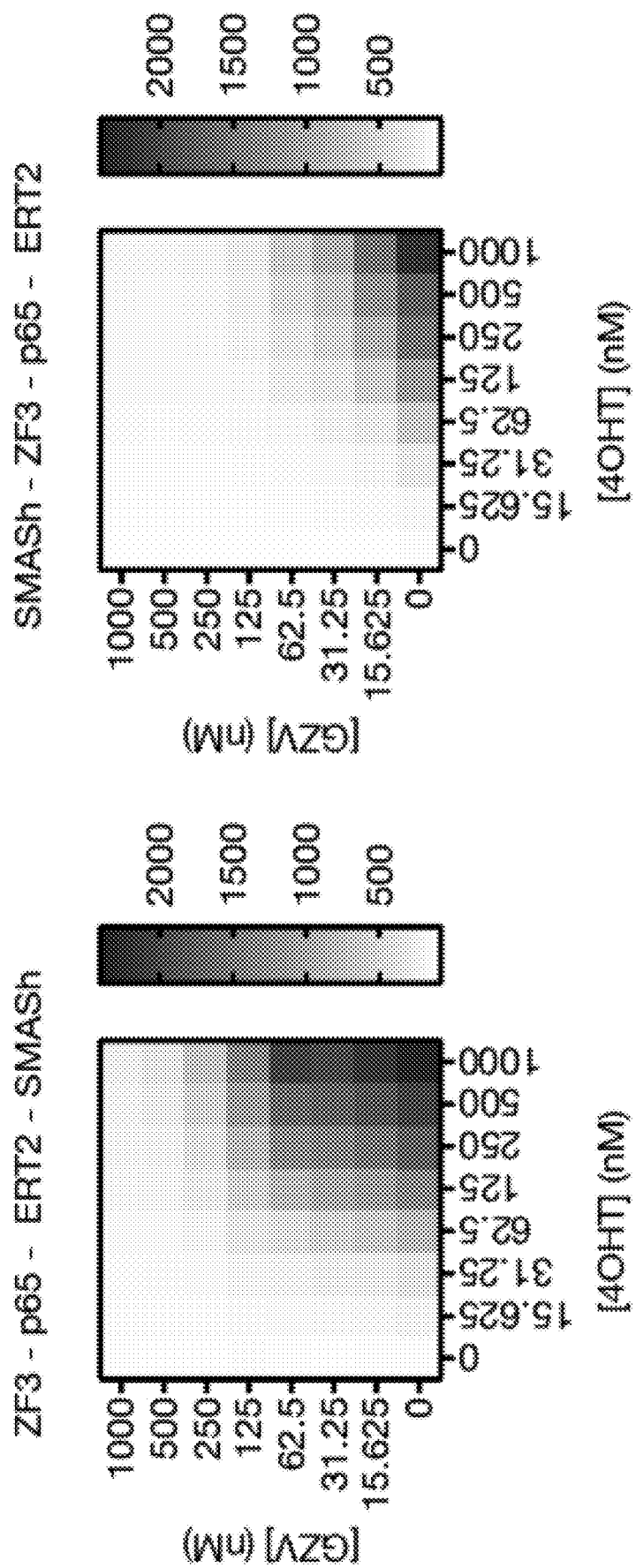
FIG. 17 is a series of heat maps showing tunable synthetic transcriptional activation of a fluorescent protein in human cell lines using ERT2 and SMASh domains with C-terminal SMASh synTF (left heat map) and N-terminal SMASh synTF (right heat map).

Tunable synthetic transcriptional activation of a fluorescent protein in human cell lines using ERT2 and SMASh domains: Two Jurkat T cell lines were tested: (1) ZF-p65-ERT2-SMASh (C-terminal SMASh) and (2) SMASh-ZF-p65-ERT2 (N-terminal SMASh). Co-administration of varying amounts of an ERT2-responsive small molecule (4OHT) and SMASh-responsive small molecule (GZV) for 4 days led to varying levels of temporal activation of a fluorescent protein from a ZF-responsive promoter. Absence or minimal 4OHT in all conditions led to little-to-no activation. Presence or near-maximal led in all conditions led to little-to-no activation. Presence of 4OHT AND absence of GZV leads to maximal activation. C-terminal and N-terminal SMASh variants exhibited differential sensitivities to GZV concentration (see e.g., FIG. 17).

Figure 18:
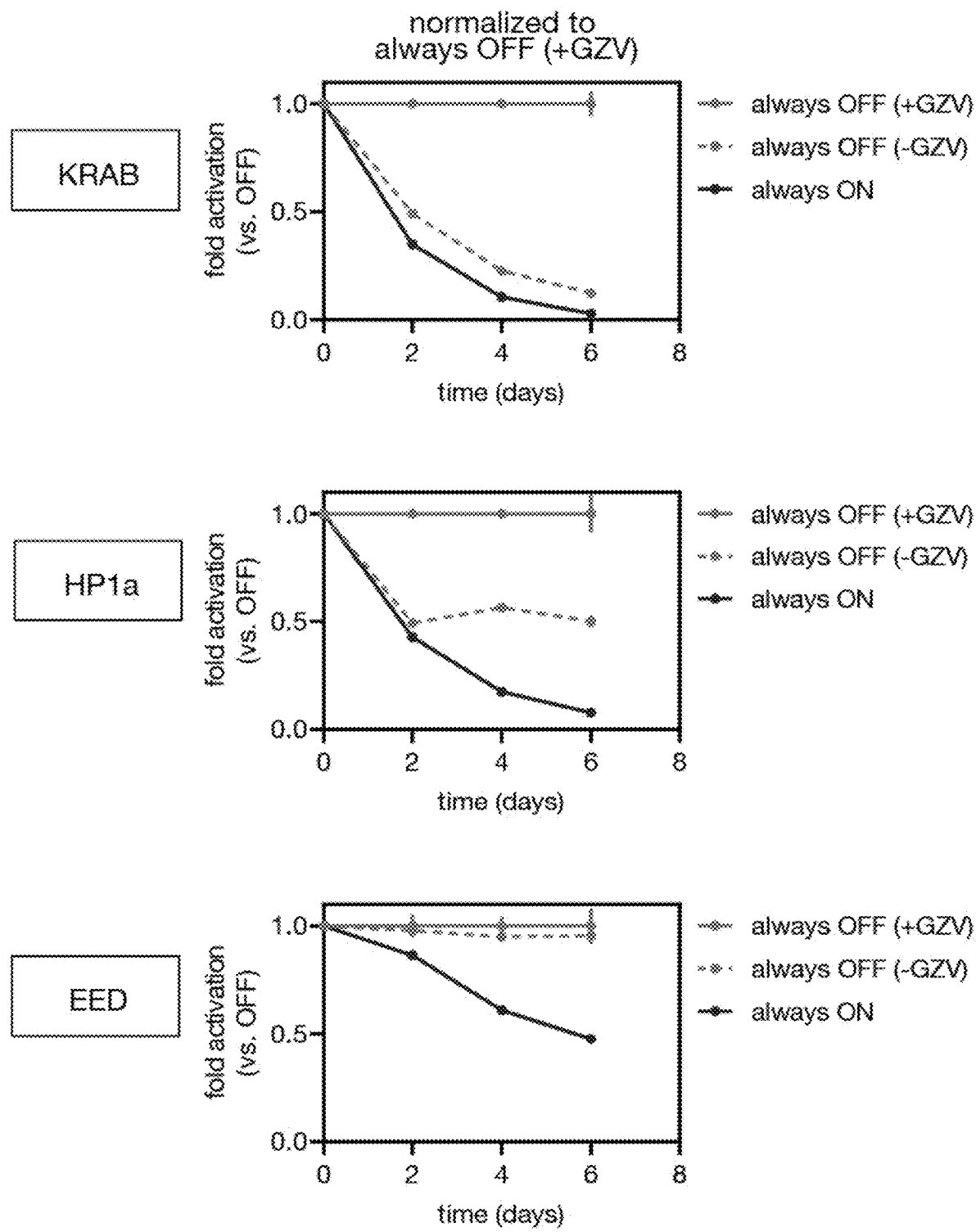
FIG. 18 is a series of line graphs showing inducible synthetic transcriptional repression of a fluorescent protein in human cell lines using KRAB-ZF-ERT2-SMASh (top graph), HP1a-ZF-ERT2-SMASh (middle graph), and EED-ZF-ERT2-SMASh (bottom graph). "Always OFF (+GZV)" indicates the presence of grazoprevir and the absence of 4OHT. "Always OFF (−GZV)" indicates the absence of both grazoprevir and 4OHT. "Always ON" indicates the absence of grazoprevir and the presence of 4OHT.

Inducible synthetic transcriptional repression of a fluorescent protein in human cell lines using ERT2 & SMASh domains: Three Jurkat T cell lines were tested: (1) KRAB-ZF-ERT2-SMASh; (2) HP1a-ZF-ERT2-SMASh; and (3) EED-ZF-ERT2-SMASh. Administration of an ERT2-responsive small molecule (4OHT) for 6 days led to temporal repression of a fluorescent protein from a ZF-responsive promoter in all cell lines. Absence of a SMASh-responsive small molecule (GZV) in the negative control led to significant "leaky" repression in the absence of 4OHT (see e.g., FIG. 18).

Example 2: Mammalian-Optimized, Cooperatively Self-Assembling Synthetic Transcription Factors (synTFs) and Drug-Inducible Controllers of Mammalian Gene Expression Cells activate precise gene expression programs in response to multifactorial chemical and biological stimuli. The purposeful manipulation of this process is a principal goal of synthetic biology, and its application to human cells can lead to breakthroughs in the understanding of human biology and in the development of next-generation diagnostics and therapeutics that respond in sophisticated ways to disease. Indeed, diverse applications, from basic studies of oncoproteins to cell reprogramming to cell therapy development, demand precise and tunable control of gene expression outputs in response to input signals. Unfortunately, tools to artificially control gene expression in mammalian cells have significant limitations, greatly constraining the ability to study fundamental biological processes and engineer designer cell-based therapies. The most widely-used tools are older generation technology, derived from bacterial transcriptional systems; these impose restrictions on the number of genes that can be simultaneously controlled, are not tunable, and cannot flexibly integrate new input signals. As a consequence, researchers are unable to create sophisticated gene expression controllers that can flexibly sense and integrate biochemical signals (e.g. ligands, chemical inducers, morphogenetic cues), and correspondingly produce tunable activation profiles. Among the many biomedical applications that would be transformed by these precision gene expression controllers in mammalian cells is the development of cell-based therapeutics for cancer, autoimmunity, and regenerative medicine, which can suffer from issues related to over-activation and tissue specificity.

Described herein are compositions, methods, and systems for controlling gene expression control in mammalian cells. Described herein is an expansion of the "signal processing" capacity of designer human cells to enhance their specificity, control, and activity for desired biomedical applications. Without wishing to be bound by theory, the central hypothesis is that this expanded signal processing can be achieved using cooperative, combinatorial transcriptional regulation schemes, in lieu of current gene expression systems that are based on "simple", one-to-one regulation. Such a hypothesis is based on the observation that in metazoa, signals are processed and integrated using large, multivalent transcription factor (TF) complexes that cooperatively assemble to activate gene expression.

Described herein is an information-processing module for mammalian gene expression control. Functionality is demonstrated in human primary immune cells because of the fundamental role that they play in human physiology and their use in cellular immunotherapy. Described herein are inducible controllers regulated by orthogonal, FDA-approved drugs. The controllers are expressed by standard viral vectors, and they are demonstrated to drive regulated expression of reporters or gene products (synTFs and cytokines) of therapeutic importance for autoimmunity and cancer. Accordingly, described herein are mammalian-optimized, cooperatively self-assembling synthetic transcription factors (synTFs) and drug-inducible controllers of mammalian gene expression.

Such drug-inducible controllers permit precision gene expression control across mammalian systems. In addition to expanding the sense-and-response capabilities of engineered human cells for improving cellular therapies, such controllers are broadly useful for basic biomedical research. This includes permitting drug-inducible, temporal control over multiple gene products simultaneously (e.g. oncoproteins or reprogramming factors).

Gene Expression Control Systems: Promise and Limitations.

The purposeful manipulation of information flow in living systems is the ultimate goal of synthetic biology, and its application to human cells can lead to breakthroughs in the understanding of human biology and in the development of next-generation diagnostics and therapeutics. In particular, gene expression technologies have played a vital role in regulating such information flow in cells for a wide range of applications. For example, the developmental process to form organoids is genomically encoded in stem cells in the form of gene regulatory networks (GRNs). Manipulation of GRNs through gene expression control circuits has proven to be fruitful in programming and guiding morphogenesis in vitro. In animal model development, tissue-specific and small molecule inducible promoters are often used to achieve organ-specific and temporal control of gene expression. Furthermore, the c-fos promoter has been used to functionally label activated neurons in mice and control the expression of an optogenetic channel rhodopsin protein to artificially recall fear memory with light stimulation. Finally, ectopic overexpression of chimeric antigen receptors (CARs), fusions of an antigen-specific scFv and T cell signaling domains, in human T cells can redirect their specificity toward cancer, with high efficacy against acute lymphoblastic leukemia (ALL) in recent clinical trials.

While current gene expression technologies have led to fundamental and therapeutic breakthroughs, their shortcomings are also abundant. For instance, the inefficiency of cell reprogramming from induced pluripotent stem cells is often attributed to key proteins and transcription factors not being expressed at the right concentrations and times. Also, the c-fos promoter is known to have variable activity in different neurons, rendering it unusable in many applications. Furthermore, many off-target effects have been documented for tissue-specific promoters, thus confounding data interpretation. Lastly, while promising, cellular immunotherapy has also shown (fatal) adverse side effects often due to a combination of issues related to cell specificity, over-activation, and unexpected interactions with the native immune system and tissue microenvironments.

Cumulatively, the aforementioned issues are the result of fundamental limitations in current gene expression control systems, which has restricted researchers' abilities to engineer sophisticated "signal processing" into mammalian cells. First, the number of transcriptional control systems in use is small, exacerbated by the existence of one well-developed and widely-used chemically inducible gene expression system (TetR-based tTa). This means that researchers can only reliably conditionally induce one gene product at a time in mammalian cells. Second, the systems are virtually all derivatives of canonical microbial transcriptional systems (e.g. TetR). While highly active, these systems have fixed response profiles, and strategies for predictively reshaping their activation profiles to precisely tune how a therapeutic protein is produced are non-trivial. Thus, whether designing cell-autonomous or exogenously inducible controllers, current tools cannot flexibly integrate novel input signals and produce customized transcriptional programs (outputs) for desired applications.

Described herein is a powerful information-processing module for mammalian gene expression control. The synTF framework is compatible for human cell engineering applications: it is composed of small, entirely human-derived protein domains that are highly tunable and is easily delivered using established viral vectors. Functionality is demonstrated in human primary immune cells because of their importance to human physiology and their use in cellular immunotherapy. To showcase its flexibility and generalizability, this core system is used as the basis of constructing different types of useful gene expression controllers in engineered immune cells, such as inducible controllers that are exogenously controlled by administration of orthogonal, FDA-approved drugs. These controllers are linked to the production of therapeutic genes (synTFs and cytokines), thereby informing applications of the controllers to enhance signal processing features (increased specificity, control and activity) of next-generation cellular therapeutics for cancer, autoimmunity and regenerative medicine.

Key innovations include a new class of synthetic TF systems specifically optimized for mammalian cell regulation, with the following characteristics: human-derived components, compact genetic payloads for facile delivery using established viral vectors, modular domains with tunable molecular properties, and specific regulation that is orthogonal to the native transcriptome. Also described herein is a set of new and orthogonal drug-inducible gene expression systems for mammalian cells, demonstrated to allow tunable control of synTF and cytokine production in human primary immune cells.

Current tools for controlling gene expression in mammalian cells are severely limited. Creating new precision gene expression controllers in human cells requires development of transcriptional systems (1) with an expanded set of orthogonal DNA-binding moieties, (2) that are responsive to safe deliverable chemicals beyond tetracycline antibiotics, and (3) that permit highly tunable activation/response profiles. Described herein is the characterization a new class of "mammalian-optimized" synthetic TF (synTF) systems that fulfill these requirements. These synTFs are used in drug-inducible controllers to tune activation profiles of therapeutic gene products in human primary immune cells.

Generation and Characterization of Mammalian synTFs Based on Orthogonal Zinc Finger Arrays Mammalian synTFs were developed for precise, effective, and orthogonal transcriptional control in human cells. The synTFs are based on artificial C2H2 zinc finger (ZF) arrays. ZFs are the most common DNA recognition motifs amongst natural human (and all eukaryotic) TFs. ZFs offer four key advantages as a basis for engineering artificial transcription control systems in human cells: (1) They are human-derived (unlike TALEs or CRISPR/Cas9) and thus less likely to elicit undesired immune responses. Indeed, older-generation ZF systems were shown to be clinically viable strategies for achieving long-term regulation of a therapeutic gene product in primates. (2) Unlike their bulkier counterparts (e.g. CRISPR/Cas9), ZF proteins are small (~30-AA domain binds 3 bp of DNA), permitting compact genetic payload designs that are easily packaged and delivered using common viral vectors. (3) As described below, ZF-based synTFs have a modular design with highly tunable molecular properties. (4) ZF arrays with customized DNA-binding specificities can be engineered to generate diverse synTF-DBM specificities. ZF-based synthetic transcriptional regulators that target genome-orthogonal DBMs have yet to be developed for mammalian engineering applications.

Generation and Evaluation of a Library of Mammalian, Orthogonal synTFs

Described herein is a workflow for creating 6-unit ZF arrays that target defined 20-bp DBMs, a length that in principle provides unique addressability in the human genome. The workflow leverages modular assembly and functional selection of 6-unit arrays from of 2-unit building blocks. Using this approach, a library of eleven 6-unit arrays was created with binding specificities chosen to maximize orthogonality to the human genome (see e.g., US Patent Publication US20180057838, the content of which is incorporated herein by reference in its entirety). We fused these arrays to human transcriptional effector domains (p65 activation domain, KRAB/HP1a silencing domains) to create humanized minimal synTFs (see e.g., FIG. 1A). To test their activity, corresponding HEK293FT reporter lines were generated harboring synTF-responsive reporter constructs, composed of 4 tandem 20-bp DBMs upstream of a minimal promoter driving transcription of a fluorescent protein (see e.g., FIG. 1B). Transduction of reporter cells with each synTF expression construct revealed strong activation of their corresponding reporters (see e.g., FIG. 1C), but did not activate non-cognate reporters (see e.g., FIG. 1D). Next, RNA-seq measurements were used to map the impact of the synTFs on genome-wide transcription. synTF regulation profiles were highly specific, showing minimal effects on native transcript profiles (see e.g., FIG. 1E-1G). Importantly synTF transcriptome profiles compared favorably with classic Gal4 and TetR-based systems, with some synTFs demonstrating superior specificity based on differential regulation analysis (see e.g., FIG. 1H). A rigorous framework was used to perform this analysis, including assessing profiles against 3 independent biological references. Together, these data demonstrate that the 6-unit ZF arrays can be used to engineer synTFs that are specific and effective regulators of mammalian gene expression. These experiments also establish a pipeline for creating and evaluating synTFs. Further supporting the rigor of the tool development is that one of these ZF synTFs was used to permit robust and specific epigenetic regulation in mammalian cells (see e.g., Park et al. Cell 176, 227-238 e220, (2019)).

Generation of synTF Affinity Variants as "Parts" for Design of Gene Expression Controllers Two orthogonal synTFs from the library (ZF1 and ZF10) that show exceptionally high in vivo activity and transcriptomic specificity were selected for further development. synTF/DBM affinity ($K_t$) variants for these synTFs were generated. Affinity variants serve multiple purposes. First, modulating synTF binding affinity is a useful strategy for tuning transcriptional output levels. To populate the mammalian "parts" toolkit, affinity series of ~10 variants were generated for each synTF (see e.g., Tables 10-12, SEQ ID NOs: 122-180, 192).

A combination of three strategies were used to generate ZF-DBM affinity variants spanning low nM-mid µM: (1) Alanine mutation of conserved arginine residues in the ZF (outside of the DNA recognition helix) that mediate DNA phosphate backbone interactions. (2) Truncation of full-length 6-unit ZF arrays to 4-unit subarrays. (3) Nucleotides mutations both within and directly flanking the core DBM. The activity of these variants can be evaluated using the above-described in vivo reporter assay. Subsequently, affinities can be directly measured using in vitro binding assays. Briefly, ZF-MBP fusion proteins are purified for each variant. Fluorescence anisotropy (FA) binding measurements are conducted, performing a competitive titration of DBM species against a pre-bound FITC-labeled oligo probe harboring a single WT DBM. Binding curves can be obtained for the full set of DBM variants, and $K_t$ values are extracted by fitting the data to a quadratic binding equation. The outcome of this work is a set of mammalian synTF "parts" (with measured DBM-binding affinities) that can be used to design gene expression controllers.

Development of Drug-Inducible synTF Controllers and Testing of their Ability to Temporally Control synTF and Cytokine Outputs in Human Primary Immune Cells Described herein are inducible gene expression controllers responsive to orthogonal FDA-approved drugs, offering the ability to multiplex gene expression and permit temporal expression control over desired proteins in mammalian cells. Controllers were engineered by fusing synTFs with ligand responsive domains and their performance were evaluated in human T cells (e.g., primary T cell lines and Jurkat T cell line), which were chosen based on their established importance to human physiology and translational research. Precise control of gene expression in human T cells remains challenging, especially in primary T cells. Thus, establishing these systems in these cells provides a basis for applying them in other challenging cell types. The inducible systems were used to control anti-Her2 synTF and IL-12 expression. Anti-Her2 synTF T cells have shown promise in treating sarcoma in clinical trials, but can have devastating on-target-off-tumor side effects. Similarly, IL-12 has potent anti-tumor activity, but is complicated by dose-limiting toxicity. Therefore, regulated expression of anti-Her2 and IL-12 can improve their safety profile.

Figure 9A:
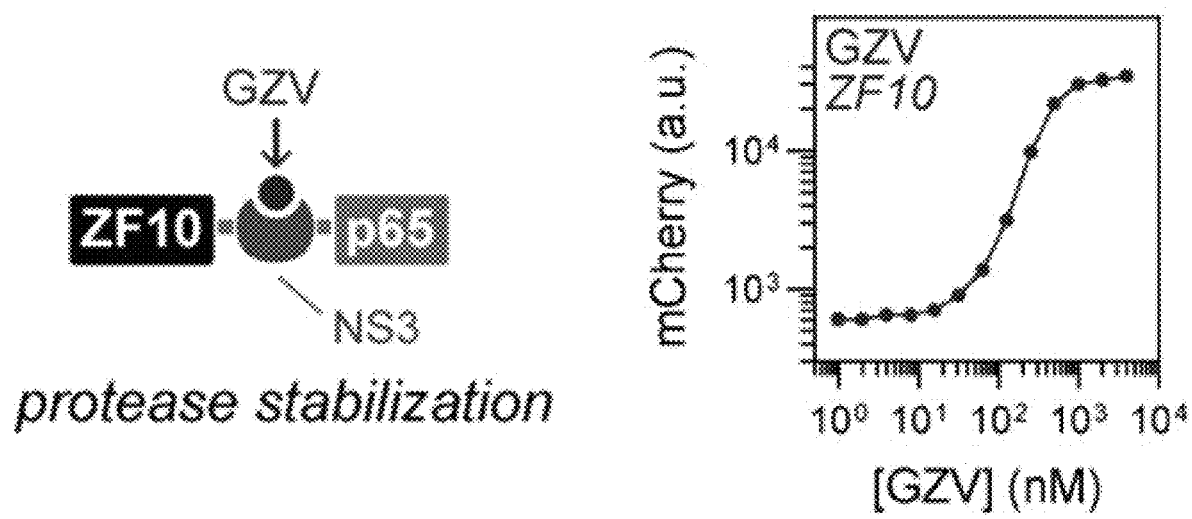
FIG. 9A-9C is a series of schematics of an exemplary repressible protease synTF, with NS3 as the protease, and graphs showing that administration of a small molecule (grazoprevir) led to temporal activation of a fluorescent protein output from a ZF-responsive promoter in Jurkat cell lines.
Figure 9B:
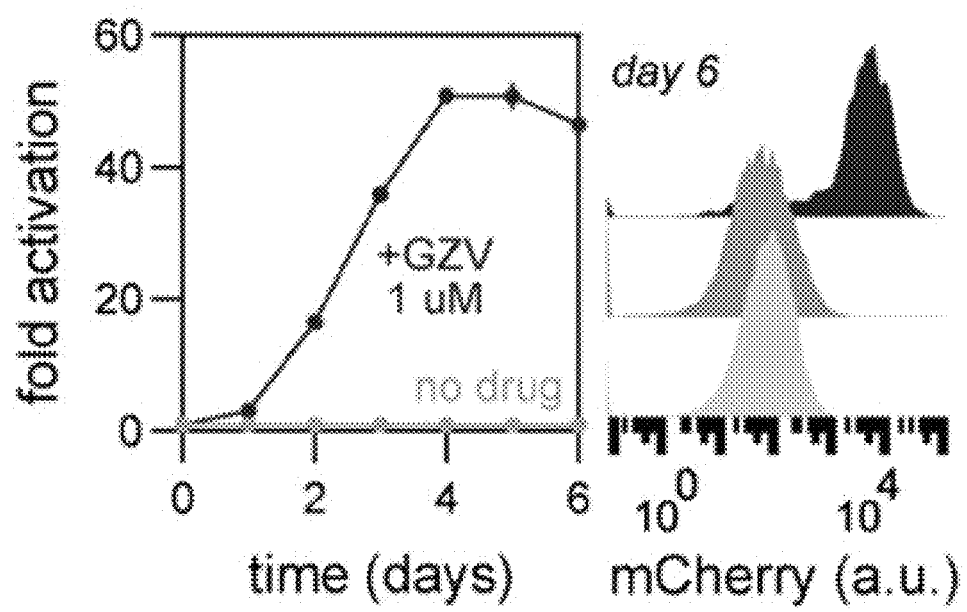
Figure 9C:
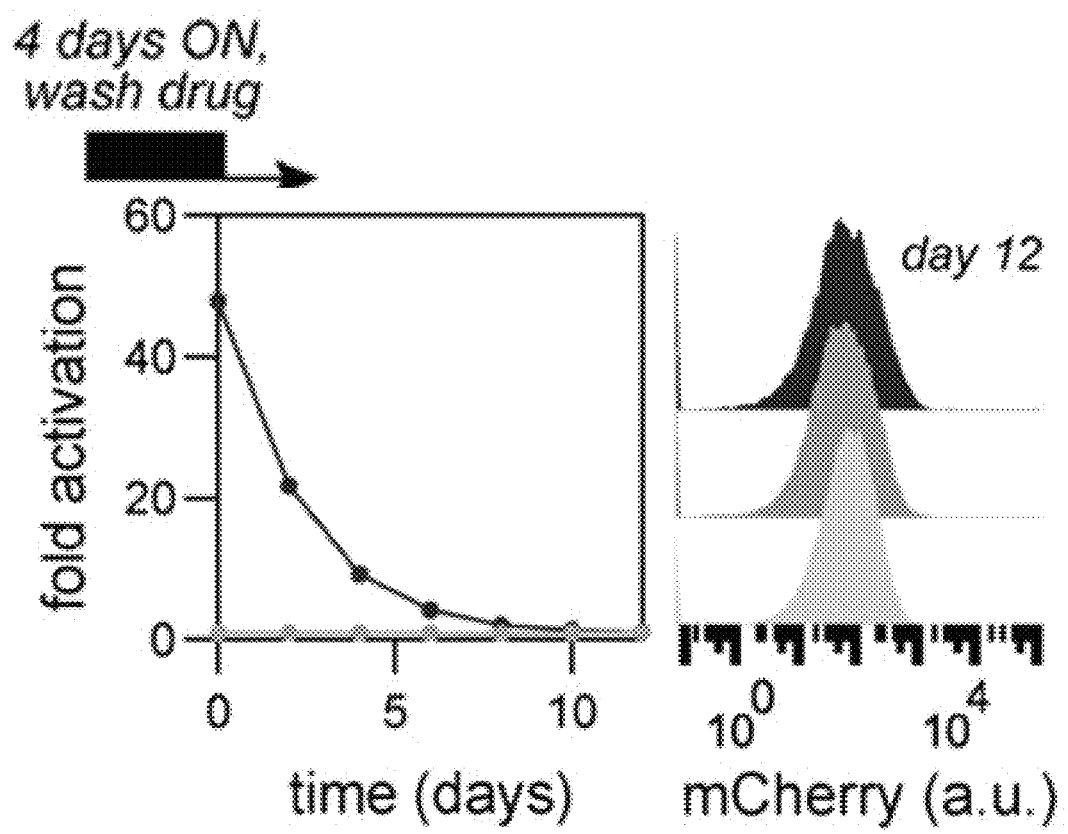
Figures 10A, 10B:
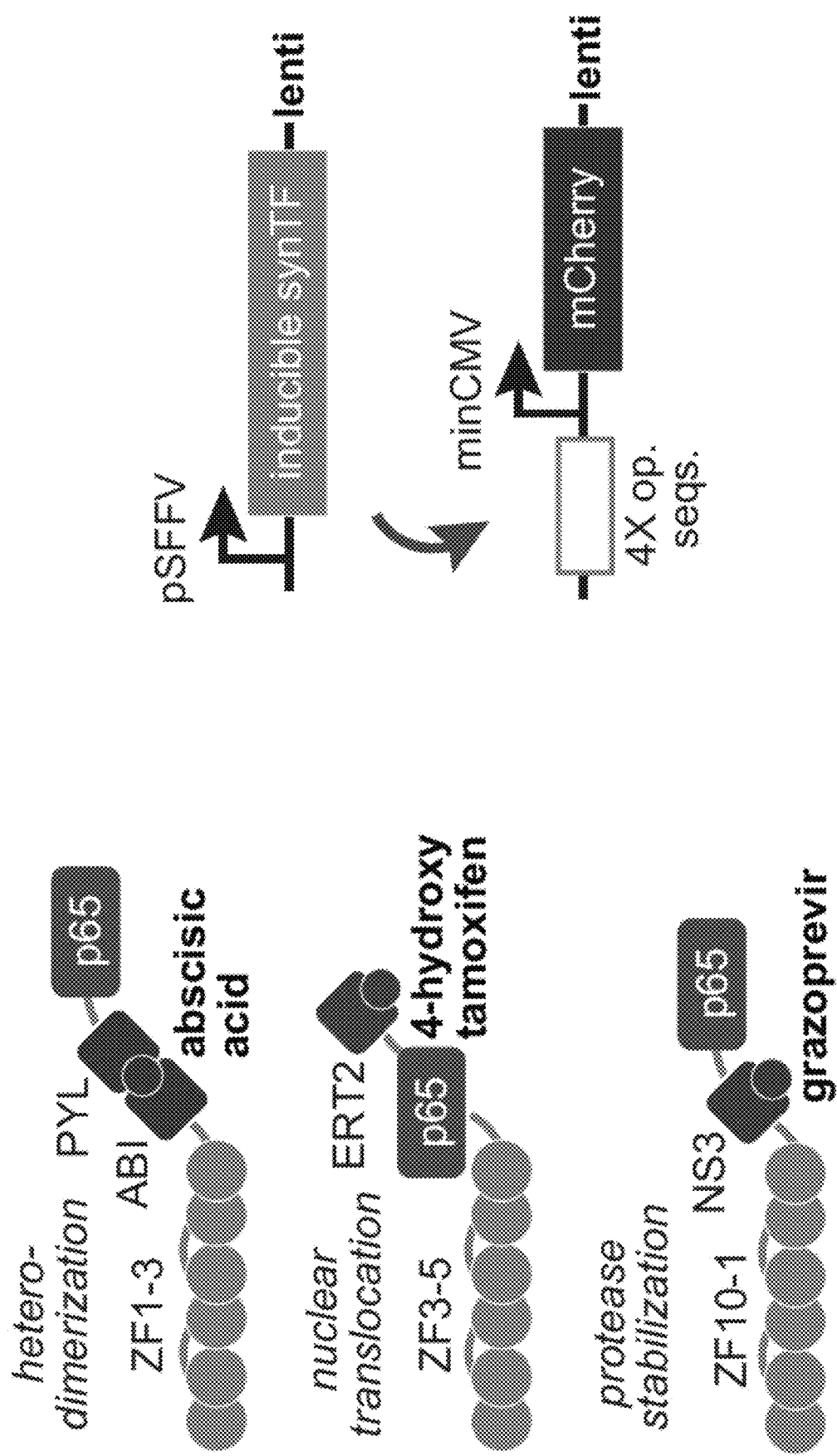
FIG. 10A-10D is a series of schematics showing exemplary synTFs and graphs showing that administration of a small molecule (e.g., ABA, 4OHT, or grazoprevir) led to temporal activation of a fluorescent protein output from a ZF-responsive promoter in both HEK293 and Jurkat cell lines.
Figure 10C:
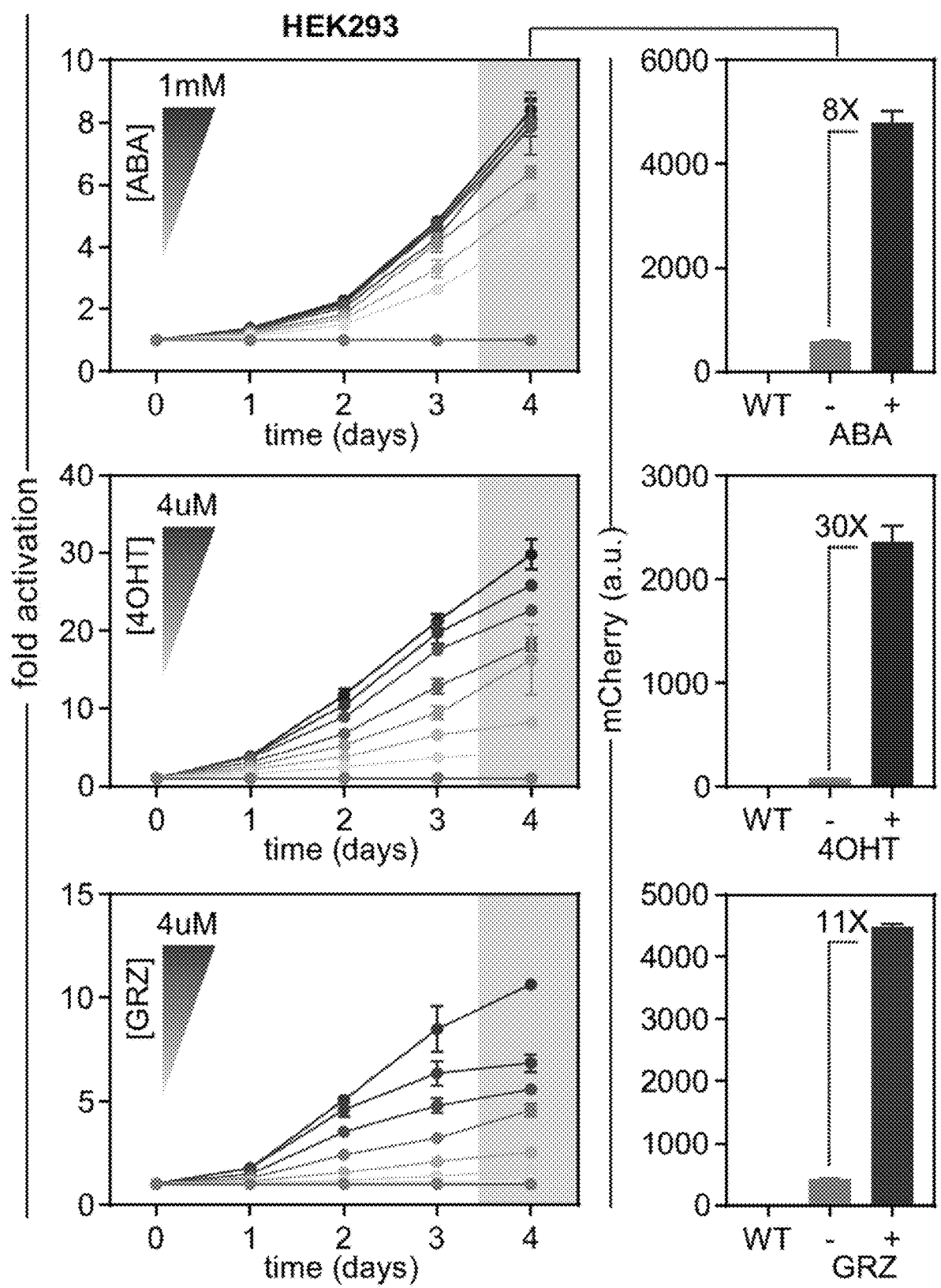
Figure 10D:
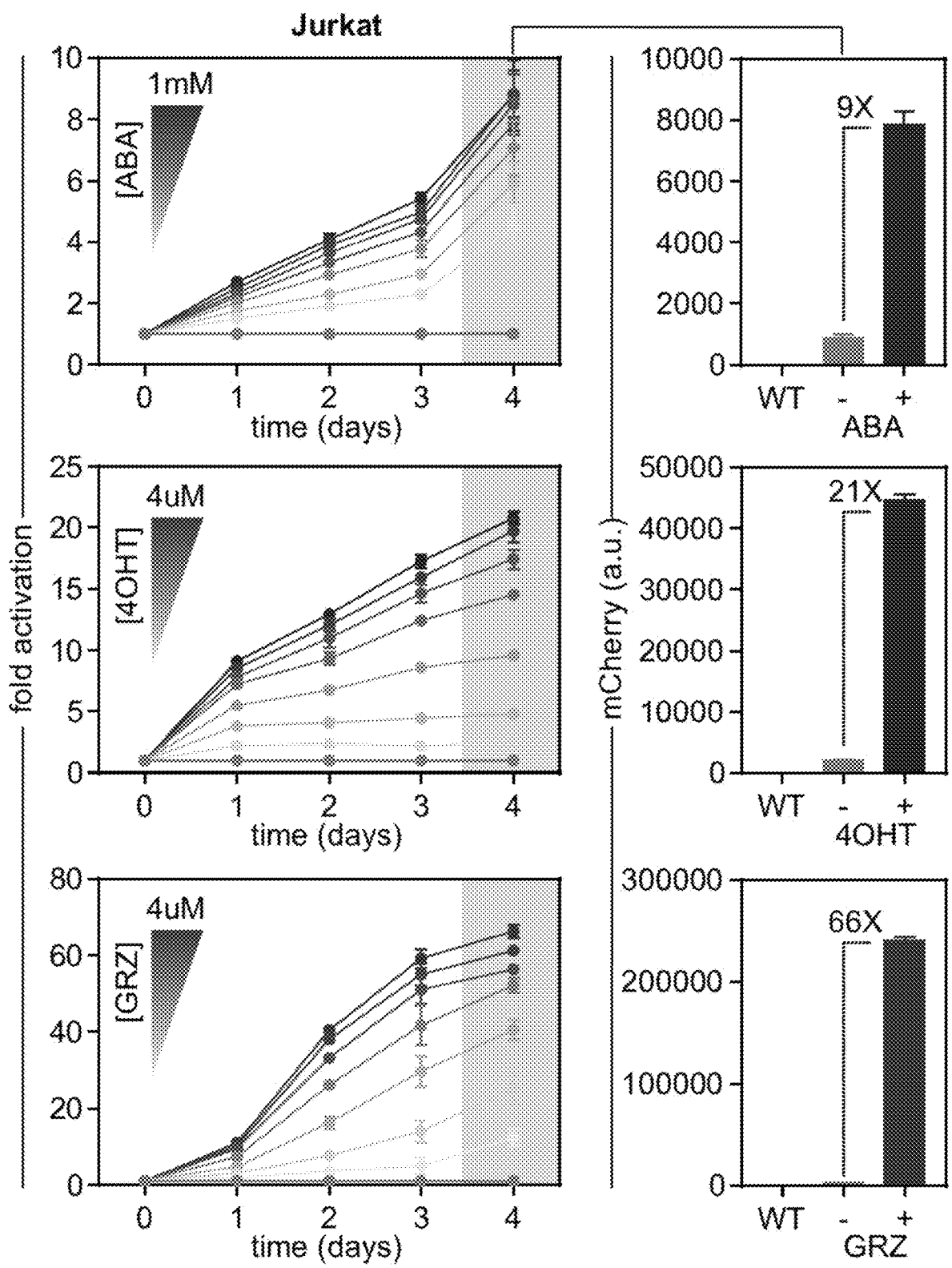

Drug-Inducible synTFs Enable Regulated Expression Control of Therapeutic Gene Products in Primary Human Immune Cells To obtain control over synTF activity, a non-structural protein (NS3) domain was fused to a synTF (see e.g., FIG. 9A-9B). NS3 is a self-cleaving protease that originates from the hepatitis C virus (HCV), and has been used as a degradation tag for controlling protein expression. In the absence of drug, NS3 cleaves the p65 activation domain away from the ZF domain, preventing gene transcription. When the cell-permeable FDA-approved inhibitor Grazoprevir (GZV) is present, NS3 protease activity is blocked, leaving the synTF intact. The NS3 system was chosen, in part, because of the exceptional safety profile of GZF, which is commonly taken at a high dose (e.g., 100 mg/day) for up to 12 weeks. Compact, GZV-inducible synTF controllers can be packaged into a single lentivirus. This permits regulated expression control of therapeutically-relevant transgenes in human immune cells (e.g. IL-10 controller; see e.g., FIG. 15A-15C), or dose- and time-dependent expression control of a CD19 CAR that functions in CD4+ primary human T cells (see e.g., FIG. 13A-13D). These studies demonstrate of the utility of drug-inducible synTF controllers for modulating mammalian gene expression.

Development and Evaluation of Orthogonal Drug-Inducible Gene Expression Controllers System Design: Developing synTF controllers that are responsive to orthogonal FDA-approved drugs offers the ability to multiplex gene expression control. Described herein are engineered controllers that are regulated by: (1) 4-Hydroxytamoxifen (4OHT), a metabolite of the FDA-approved breast cancer drug tamoxifen that selectively modulates the activity of molecules fused to estrogen receptor variants (such as $ER^{T2}$), and (2) GZV (as described above). 4OHT- and GZV-inducible systems were generated by fusing the ligand binding domains to two orthogonal synTFs. Human p65 was used as the activation domain, and expression of the synTF was controlled by a constitutive promoter (e.g., EF1-a). The inducible synTF was placed in the same pHR lentiviral vector as the corresponding synTF-responsive promoter driving a gene of interest.

System Evaluation: Described herein are assays for GFP, synTF, and cytokine expression, as well as assays for synTF activity in Jurkat or human primary T cells. The relative performance of the different genetic circuits in Jurkat T cell line can be evaluated by testing in human primary CD8 T cells. Jurkat cells were used because of their value to the understanding of T cell biology, and their ability to scale the assay pipeline at cost. Strongly expressing synTFs in Jurkat are similarly strong in primary T cells.

Inducible synTFs were first characterized using GFP (or another detectable marker such as mCherry) as the reporter. The whole system was introduced into Jurkat T cells via lentiviral transduction with multiplicity of infection of 25 to ensure high efficiency, quantifying viral copy number (VCN) with qPCR. To characterize the inducible synTF controllers, cells at 5×10⁴ cells each in 96-well plates were inoculated with lentivirus, and eight different drug concentrations were added spanning three orders of magnitude (e.g., GZV 0-10 μM, 4OHT 0-1 μM), and GFP expression levels can be quantified with flow cytometry (see e.g., FIG. 10A-10D). Gene expression levels can be normalized to VCN. From these dose-responses, the dynamic range and threshold of activation can be defined. Since the single vector design can lack a selection marker, transduction efficiency was assumed to be equal to the percentage of GFP positive cells after induction by 4OHT or GZV.

To demonstrate translational potential, an inducible system demonstrating a larges dynamic range can be selected to control synTFs or cytokine expression in human primary CD8 T cells. Controller circuits can be engineered by replacing GFP with a therapeutic protein (e.g., anti-Her2 synTF or IL-12), introduced into human primary CD8 T cells via lentiviral transduction, and evaluated using methods as described herein. Briefly, using ROSETTASEP and SEPMATE kits (STEMCELL Technology), primary human T cells can be purified from leukopaks of anonymous male and female donors obtained from a blood bank. synTF expression levels in the presence or absence of inducer are measured by immunostaining for myc-tagged synTF, and IL-12 expression is measured by ELISA. To activate the synTF, 5×10⁴ engineered T cells are mixed in 96-well plates with Her2 expressing K562 cells at 1:1 ratio. T cell activation is measured via cytokine production (e.g., IL-2 and IFN-g), cell killing, and proliferation. Cell killing is measured by the number of live K562 cells (e.g., fluorescently labeled) through flow cytometry. T cells constitutively expressing synTF or cytokine, and cells lacking synTF or cytokine are tested as controls. Each sample is performed in triplicate. Statistical significance between samples can be determined by student's T-test (two-tailed). Values of <0.05 are considered significant. To ensure reproducibility, each experiment is independently repeated >3 times.

Example 3: Synthetic Transcription Regulation for Immune Cell Therapy

Overview: Next generation cell therapies seek to create designer immune cells that can sense and respond to disease in sophisticated ways. Achieving this goal fundamentally requires engineered regulatory elements and circuitry that can be used to program human cell functions by processing complex environmental inputs and mediating precisely regulated expression of therapeutic agents. Towards this goal, synthetic transcriptional programs can interface with sense and response modules to enable new layers of regulation in cells (see e.g., FIG. 1A-1B).

To advance immune cell therapies beyond reliance on simple constitutive expression of therapeutic agents, there is a need for programmable genetic components that offer tunable and versatile regulatory profiles. Moreover, these components must themselves have properties that are compatible with the human therapeutic context, including high specificity, low immunogenicity, and deliverability.

Engineered zinc finger (ZF) domains are promising moieties for transcriptional regulation in human cells as they are able to address aforementioned considerations. These naturally compact DNA-binding elements are ubiquitous in eukaryotic transcription factors. They have a modular design with programmable sequence recognition and customizable molecular properties. There has been extensive foundational work to understand the structure and programmability of these motifs to achieve useful gene regulatory functions.

Described herein is a synthetic transcriptional regulatory platform suitable for applications in therapeutic gene regulation. A library of engineered ZF domains with recognition sequences that are unique and orthogonal to the human genome is engineered and utilized, and these minimal regulators are connected to drug-responsive domains to achieve controlled gene expression. This framework broadly permits sophisticated gene expression programs for immune cell therapy.

Such a platform for synthetic transcriptional regulation of therapeutic genes can be used in T cells. These core transcription factors of the synTFs are highly advantageous for therapy due to their compact size and native derivation from mammalian systems. These factors were connected to small molecule-responsive domains in order to control their activity (e.g., in T cells) by administration of safe and/or FDA-approved drugs.

Construction of Synthetic Zinc Finger-TF Library: A library of synthetic transcription factors was constructed utilizing engineered 6-unit zinc finger (ZF) domains with 18 bp binding motifs that are unique and putatively orthogonal to the human genome. The activity of minimal transcriptional regulators against cognate and non-cognate reporters was evaluated in HEK293 cell lines (see e.g., FIG. 1C-1D).

Evaluation of Transcriptome Response: Changes in cellular transcriptome response upon expression of our synthetic transcriptional regulators were measured in HEK293 cell lines. These global transcriptome profiles were compared to those of widely-used "orthogonal" DNA binding domains (e.g., Gal4, TetR) (see e.g., FIG. 1F-1H).

Development of Inducible Transcriptional Regulators: The transcriptional regulators were coupled to inducible domains to temporally modulate gene expression. Candidate inducible elements were selected that are responsive to small molecules that are FDA-approved drugs or known to be safe in humans. The dose- and time-dependent activity of the inducible transcriptional regulators was evaluated in both HEK293 and Jurkat cell lines (see e.g., FIG. 2-4, 5A-5C, 6A-6B, 7A-7C, 8A-8C, 9A-9C, 10A-10D).

Control of Immune Cell Function: One of our small molecule inducible regulatory systems (e.g., an NS3-regulated synTF) was utilized to temporally modulate the expression of a CD19 Chimeric Antigen Receptor in primary CD4+ T cells and to permit tunable production of cytokines upon cellular activation (see e.g., FIG. 13A-13D).

Example 4: A Platform for Synthetic Transcriptional Regulation in Human Cells

Therapeutic cells can be engineered to sense and respond to disease in sophisticated ways. Cells are naturally capable of integrating and processing diverse environmental signals. Cells are naturally perceptive and adaptable devices that process information across space and time using their underlying genetic and epigenetic programs. Artificial genetic programs can endow human cells with new and increasingly complex therapeutic functions.

The field of synthetic biology has really contributed to all of these areas: (1) from developing strategies to identify diverse signals (e.g. artificial receptors, responsive proteins), (2) new platforms and cellular logic modules to interpret information (e.g. transcriptional networks, signaling cascades), and (3) translating these into desirable and effective responses and therapeutic outputs (e.g. corrective transgenes, stimulatory molecules). By engineering human cells with genetic programs, the cells are presented with new opportunities to integrate and process signals associated with disease, and to ultimately therapeutically respond in sophisticated ways.

Transcription factors (TFs) naturally regulate cellular behaviors. New genetic elements can advance the signal processing capabilities of therapeutic cells. With regard to information processing, transcription factors are often utilized as key mediating regulatory elements within circuits and genetic programs, due to their intrinsic ability to locally and conditionally the regulate expression of genes. TFs fundamentally govern genomic processes and interesting cellular behaviors (e.g., potent gene activation and silencing, differentiation, enhancers, etc.) These complex behaviors often emerge due to unique TF features in eukaryotic contexts (e.g., specificity for enhancer sequences, ability to modify DNA structure and chromatin, ability to interact cooperativity, ability to regulate different genes temporally and in sequence, etc.).

Historically, heterologous TFs have been co-opted from prokaryotic systems (e.g., Gal4, TetR, LacI and others) to "orthogonally" control programs in human cells. While this itself has permitted many significant foundational advancements in the mammalian synthetic biology field, there are a relatively limited amount of regulatory properties and useful behaviors that these "primitive" parts can be used to uncover.

There remains a persistent need for new regulatory elements that can allow cells to process more channels of information in more reliable ways. Synthetic transcriptional regulation can permit controllable expression. Described herein are artificial eukaryotic TFs with customizable properties, including an exploration of how engineered cooperative interactions between such TFs can give rise to complex signal processing behaviors.

Engineered genetic components can be used for precise and versatile transcriptional regulation in human cells.

Regarding the development of next-generation regulatory elements for therapeutic applications in human cells, the following are favorable properties of such TFs.

Such synthetic transcription factors meet the following requirements: (1) components derived from mammalian systems that are safe and non-immunogenic, (2) those that can very specifically recognize and regulate at their operator sequences with minimal off-target effects, (3) those that allow for programmable and tunable interactions with other molecular components, and (4) those that can be successfully delivered in human cells within established delivery vectors.

Engineered ZF domains are promising moieties for transcriptional regulation that address all of these considerations—they are naturally occurring, minimal DBDs in human TFs, and they can be adapted for synthetic regulation.

Engineered zinc finger domains can be used to build synthetic transcriptional regulators that can enhance the processing capabilities of human cells.

A set of artificial 6-unit ZF domains were developed that specifically recognize 18 bp DNA operators; they are distant from and orthologous to native human genomic sequences. Simple transcription regulation programs were developed by coupling these engineered binding domains to human-derived effector domains and developing responsive promoters. These programs can be interfaced in therapeutic circuits—generating inducible synTFs that are responsive to small molecules and using these controllable synTFs to modulate expression of therapeutic outputs.

Synthetic transcriptional operator sequences were identified that are orthogonal to the human genome. There exist specific challenges in programming ZF domains compared to other technologies (e.g., TALE, CRISPR) for which there is a convenient 1:1 recognition code. One ZF unit specifies 3 bp of DNA and they can be connected modularly to specify larger sequence arrays. However, there can be context-dependent activity when these ZF units are arranged within larger arrays.

To address the two-fold challenge of finding genome-orthogonal recognition sequences AND functional and active DNA binding domains, a set of 2-unit ZF subarrays was used (see e.g., J. Keith Joung (ZF Archive); U.S. Pat. No. 10,138,493 (2018)). 6 bp recognition sequences were identified that were underrepresented in the genome. Without wishing to be bound by theory, it was hypothesized that their concatenation would lead to highly distant 18 bp sequences (a length that can confer uniqueness). Arrangements of corresponding 6-unit ZFs were then screened to find those that could recognize these sequences, resulting in an initial library of 11 sequences ("operators") and corresponding 6-unit ZFs.

A bioinformatic string matching algorithm called "Biostrings" was used to evaluate the occurrence of the operator sequences in the human genome. The synthetic operators were compared to several canonical TF operator sequences (e.g., UAS/Gal4, TetO/TetR, ZFHD1). The synthetic operators generated through the described workflow performed better relative to these "heterologous" recognition sequences of similar or shorter lengths (see e.g., FIG. 31).

Described herein is a library of synthetic operator sequences and cognate transcription factors. Responsive cell lines were developed by placing synthetic operator sequences upstream of minimal promoters driving a fluorescent output, and integrating them into HEK cells. The responsive (i.e., reporter) cell lines were then transiently transfected with minimal synthetic transcription factors composed of the engineered binding domains coupled to human-derived effector domains (such as p65). These proteins were capable of binding to the array and subsequently boosting expression of the fluorescent output. Each reporter was only turned on in the presence of its corresponding synTF, and not in the negative control case using a "mock TF" with a GFP replacing the ZF domain. Testing of the mutual orthogonality of this set demonstrated that the TFs were specific to their corresponding operators and not for non-cognate sequences (see e.g., FIG. 1A-1D).

Transcriptome measurements were used to elucidate synTF specificity and genome-wide activity. The specificity and genome-wide orthogonality of our synTFs were empirically evaluated in the human genome. A singly-integrated HEK cell line constitutively expressed a synTF alongside its cognate fluorescent reporter. Total RNA was collected and a transcriptome analysis was performed to examine into the on-target regulation of the fluorescent transcript compared to off-target misregulation. These differential expression levels were compared relative to a reference line containing a GFP-p65 "mock" TF. There was significant differential activation of the mCherry in the synTF cell line, but extremely high correlation of native cellular transcripts between both cell lines, indicating that the synTFs regulate expression specifically at their target sites (see e.g., FIG. 1E-1H).

As described herein, small molecule inducible regulation is useful for control of synTF activity. Drug-controllable versions of the synthetic transcription regulators were engineered by generating TFs responsive to the presence and concentration of relevant small molecules. These are useful for tunable and temporal control over the activity of the TFs.

Reporters and synTFs were ported into lentiviral cassettes that were capable of delivering these payloads to various cell types. Three safe and/or FDA approved small molecules were used control the activity of the synTFs through different mechanisms; these mechanisms included: (1) the abscisic acid mediated hetero-dimerization of ABI/PYL domains; (2) the 4-hydroxytamoxifen mediated nuclear translocation of the ERT2 domain; and (3) the grazoprevir mediated stabilization of the viral NS3 self-excising protease. Three of the orthogonal synTF activators were connected to each inducible system (see e.g., FIG. 2-4, 5A-5C, 6A-6B, 7A-7C, 8A-8C, 9A-9C, 10A-10D).

Tunable gene activation was achieved using small molecule inducible synTFs. Inducibility profiles were determined for each of the three inducible synTF activators, in both HEK293 and Jurkat cell lines. The reporter expression was evaluated across time and varying drug concentrations. Day 4 represented the highest levels of expression that were assayed, indicating strong inducible expression in drug-treated lines relative to untreated cell lines (see e.g., FIG. 10A-10D).

Tunable gene silencing can also be achieved using small molecule inducible synTFs. Inducible synTFs were engineered that were capable of repressing gene expression. The responsive promoter was modified to constitutively express a fluorescent output. The p65 activation domain was replaced with a KRAB repression domain (human-derived silencer), and the same ZF-drug pairs were utilized as the synTF activators. Inducibility profiles were determined for each of the three inducible synTF repressors in HEK cell lines, and there was strong silencing of reporter expression over time in drug-treated lines relative to untreated cell lines (see e.g., FIG. 11A-11B, 12A-12C).

Inducible synTFs can regulate cytokine expression from a single lentiviral vector, demonstrating of the compact nature of the synTFs. A single lentiviral vector was engineered that was capable of expressing a grazoprevir-inducible synTF that would in turn regulate expression of IL-10. The size of this entire insert including expression elements was 3.5 kB, which is minimal and approaches the total payload packaging limits of certain vectors. Virus was produced to infected Jurkat cells, and there was saw strong induced expression of IL-10 in transduced cells after 2 days of grazoprevir administration, indicating that this is an efficient strategy of modulating therapeutic outputs in human cells (see e.g., FIG. 15A-15C).

Inducible synTFs can regulate synTF expression in primary cells. The grazoprevir-inducible synTF was used to control expression of a CD19-CAR in primary CD4+ cells. Using different administered concentrations of drug, dose-dependent expression of synTF was measured over time. On day 3 there was strong fold induction with the highest concentration. The grazoprevir-induced cells were then co-cultured with CD19+ antigen-presenting cells to activate the primary cells, and dose-dependent production of IFNgamma and IL-2 cytokines was subsequently measured across time. Such results highlight that the ability to reliably control expression of outputs from therapeutic, thus controlling their functionalities in increasingly complex settings (see e.g., FIG. 13A-13D).

In conclusion, building new transcriptional regulatory elements with favorable properties allows human cells to process information and regulate therapeutic functions in tunable and reliable ways. A library of orthogonal ZF binding domains and synthetic operator sequences was specifically developed, and these were used to engineer minimal transcriptional regulatory programs. As shown herein, these synTFs were used control therapeutic programs in circuits, thus demonstrating the utility of these synTFs in sophisticated gene expression programs.

Example 5: Exemplary Sequences

Induced Proximity Domains

[ABI]-[ZF]-[2A]-[p65]-[PYL] synthetic transcriptional activator: In this particular embodiment, the ZF is fused to the C-terminal of the ABI domain, while the p65 is fused N-terminal to the PYL domain. The two composite domains are expressed from the same promoter; they are separated by a 2A ribosomal skip sequence (see e.g., SEQ ID NO: 4, FIG. 19).

[ABI]-[ZF]-[2A]-[KRAB]-[PYL] synthetic transcriptional repressor: In this particular embodiment, the ZF is fused to the C-terminal of the ABI domain, while the KRAB is fused N-terminal to the PYL domain. The two composite domains are expressed from the same promoter; they are separated by a 2A ribosomal skip sequence (see e.g., SEQ ID NO: 5, FIG. 20).

Cytosolic Sequestering Domain

[ZF][p65]-[ERT2] synthetic transcriptional activator: In this particular embodiment, the p65 effector domain is fused C-terminal to the ZF domain. The ERT2 domain is fused C-terminal to the p65 domain (see e.g., SEQ ID NO: 6, FIG. 21).

[KRAB]-[ZF]-[ERT2] synthetic transcriptional repressor: In this particular embodiment, the KRAB effector domain is fused N-terminal to the ZF domain. The ERT2 domain is fused C-terminal to the ZF domain (see e.g., SEQ ID NO: 7, FIG. 22).

Self-Cleaving Protease Domain

[ZF]-[NS3]-[p65] synthetic transcriptional activator: In this particular embodiment, the zinc finger DNA binding domain is N-terminal to the NS3 domain, while the effector domain is C-terminal to the NS3 domain (see e.g., SEQ ID NO: 8, FIG. 23).

[KRAB]-[NS3]-[ZF] synthetic transcriptional repressor: In this particular embodiment, the effector domain is N-terminal to the NS3 domain, while the zinc finger DNA binding domain is C-terminal to the NS3 domain (see e.g., SEQ ID NO: 9, FIG. 24).

Induced Degradation Domain

[ZF]-[p65]-[ERT2]-[SMASh] synthetic transcriptional activator ("C-terminal SMASh"): In this particular embodiment, an ERT2 (mutated estrogen receptor domain responsive to 4OHT) is C-terminal to the zinc finger DNA binding domain and effector domain. The SMASh domain (containing NS3) is C-terminal to the rest of the domains (see e.g., SEQ ID NO: 10, FIG. 25).

[SMASh]-[ZF]-[p65]-[ERT2] synthetic transcriptional activator ("N-terminal SMASh"): In this particular embodiment, an ERT2 (mutated estrogen receptor domain responsive to 4OHT) is C-terminal to the zinc finger DNA binding domain and effector domain. The SMASh domain (containing NS3) is N-terminal to the rest of the domains (see e.g., SEQ ID NO: 11, FIG. 26).

[ZF]-[p65]-[SMASh]: In this particular embodiment, an SMASh domain (containing NS3) is C-terminal to the zinc finger DNA binding domain and effector domain (see e.g., SEQ ID NO: 12, FIG. 27).

[KRAB]-[ZF]-[ERT2]-[SMASh]: In this particular embodiment, an ERT2 (mutated estrogen receptor domain responsive to 4OHT) is C-terminal to the KRAB repressor domain and the zinc finger DNA binding domain. The SMASh domain (containing NS3) is C-terminal to the rest of the domains (see e.g., SEQ ID NO: 13, FIG. 28).

[HP1a]-[ZF]-[ERT2]-[SMASh]: In this particular embodiment, an ERT2 (mutated estrogen receptor domain responsive to 4OHT) is C-terminal to the HP1a repressor domain and the zinc finger DNA binding domain. The SMASh domain (containing NS3) is C-terminal to the rest of the domains (see e.g., SEQ ID NO: 14, FIG. 29).

[EED]-[ZF]-[ERT2]-[SMASh]: In this particular embodiment, an ERT2 (mutated estrogen receptor domain responsive to 4OHT) is C-terminal to the EED repressor domain and the zinc finger DNA binding domain. The SMASh domain (containing NS3) is C-terminal to the rest of the domains (see e.g., SEQ ID NO: 15, FIG. 30).

Sequence Tables

TABLE 2

Exemplary SynTFs (the last three columns show exemplary SEQ ID NOs)

| Description | Vector | Polynucleotide | Polypeptide |
|---|---|---|---|
| Induced Proximity Domain | | | |
| ZF1-ABI-[2A]-PYL-p65 | 16 | 28 | 4, 40 |
| ABI-ZF1-[2A]-KRAB-PYL | 17 | 29 | 5, 41 |
| Cytosolic Sequestering Domain | | | |
| ZF3-p65-ERT2 | 18 | 30 | 6, 42 |
| KRAB-ZF3-ERT2 | 19 | 31 | 7, 43, 378 |
| Repressible Protease Domain | | | |
| ZF10-p65-NS3 | 20 | 32 | 8, 44 |
| KRAB-NS3-ZF10 | 21 | 33 | 9, 45 |
| Induced Degradation Domain | | | |
| ZF3-p65-ERT2-SMASh | 22 | 34 | 10, 46 |
| SMASh-ZF3-p65-ERT2 | 23 | 35 | 11, 47, 379 |

TABLE 1

Exemplary Vectors

| Vector | SEQ ID NO | Description | Use with |
|---|---|---|---|
| Activation Reporter | | | |
| pO-066 | 52 | pHR-4X ZF1 BS-minCMV-mCherry | pMZ-314 |
| pO-081 | 53 | pHR-4X ZF3 BS-minCMV-mCherry | pO-082 |
| pO-070 | 54 | pHR-4X ZF10 BS-minCMV-mCherry | pO-080 |
| Repression Reporter | | | |
| pMN-243 | 55 | pHR-4X ZF1 BS-full CMV-mCherry-d2 | pMZ-343 |
| pMN-244 | 56 | pHR-4X ZF3 BS-full CMV-mCherry-d2 | pMZ-328 |
| pMN-245 | 57 | pHR-4X ZF10 BS-full CMV-mCherry-d2 | pMZ-329 |
| pMN-258 | 58 | pHR-4X ZF1 BS-SFFV-mCherry | pMZ-343 |
| pMN-259 | 59 | pHR-4X ZF3 BS-SFFV-mCherry | pMZ-328 |
| pMN-260 | 60 | pHR-4X ZF10 BS-SFFV-mCherry | pMZ-329 |
| Expression Vector | | | |
| pO-105 | 61 | pHR-4X ZF10 BS-minTK-CD19 CAR-mCherry | pO-080 |
| pMN-268 | 62 | pHR-4X ZF3 BS-minCMV-IL4-[2A]-huEGFRt | pO-082 |
| pO-093 | 63 | pHR-4X ZF10 BS-minTK-IL10 | pO-080 |
| pO-092 | 64 | pHR-IL10-minTK-4X ZF10 BS-pHR-pSFFV-ZF10-p65-NS3 | N/A |
| Activator Domain synTF | | | |
| pMZ-314 | 16 | pHR-pSFFV-ZF1-ABI-[2A]-PYL-p65 | pO-066 |
| pO-082 | 18 | pHR-pSFFV-ZF3-p65-ERT2 | pO-081 |
| pO-080 | 20 | pHR-pSFFV-ZF10-p65-NS3 | pO-070 |
| pMZ-431 | 22 | pHR-pSFFV-ZF3-p65-ERT2-SMASh | pO-081 |
| pMZ-432 | 23 | pHR-pSFFV-SMASh-ZF3-p65-ERT2 | pO-081 |
| pMZ-454 | 24 | pHR-pSFFV-ZF10-p65-SMASh | pO-070 |
| Repressor Domain synTF | | | |
| pMZ-343 | 17 | pHR-pSFFV-ABI-ZF1-[2A]-KRAB-PYL | pMN-243/ pMN-258 |
| pMZ-328 | 19 | pHR-pSFFV-KRAB-ZF3-ERT2 | pMN-244/ pMN-259 |
| pMZ-329 | 21 | pHR-pSFFV-KRAB-NS3-ZF10 | pMN-245/ pMN-260 |
| pMZ-440 | 25 | pHR-pSFFV-KRAB-ZF3-ERT2-SMASh | pMN-244/ pMN-259 |
| pMZ-441 | 26 | pHR-pSFFV-HP1a-ZF3-ERT2-SMASh | pMN-244/ pMN-259 |
| pMZ-442 | 27 | pHR-pSFFV-EED-ZF3-ERT2-SMASh | pMN-244/ pMN-259 |

TABLE 2-continued

Exemplary SynTFs (the last three columns show exemplary SEQ ID NOs)

| Description | Vector | Polynucleotide | Polypeptide |
|---|---|---|---|
| ZF10-p65-SMASh | 24 | 36 | 12, 48 |
| KRAB-ZF3-ERT2-SMASh | 25 | 37 | 13, 49 |
| HP1a-ZF3- ERT2-SMASh | 26 | 38 | 14, 50 |
| EED-ZF3- ERT2-SMASh | 27 | 39 | 15, 51 |

Table 3 shows the locations of specific domains in exemplary Heterodimerization Domain SynTFs polypeptide sequences.

TABLE 3

Exemplary Induced Proximity Domain SynTFs

| Element (SEQ ID NO) | ZF1-ABI-[2A]-PYL-p65 (SEQ ID NO: 4, 40) | ABI-ZF1-[2A]-KRAB-PYL (SEQ ID NO: 5, 41) |
|---|---|---|
| NLS (65) | 4-10 | 4-10 |
| ABIlcs COl (66) | 15-312 | 15-312 |
| Linker (67) | 313-317 | 313-317 |
| ZF (1 or 76) | 318-493 | 318-493 |
| NLS (65) | 494-500 | 522-528 |
| P2A (68) | 504-525 | 497-518 |
| p65 (69) | 529-719 | |
| KRAB (72) | | 529-624 |
| Linker (70) | 720-724 | 625-629 |
| PYLlcs (71) | 727-903 | 632-808 |

Table 4 shows the locations of specific domains in exemplary Translocation Domain SynTFs polypeptide sequences.

TABLE 4

Exemplary Cytosolic Sequestering Domain SynTFs

| Element (SEQ ID NO) | ZF3-p65-ERT2 (SEQ ID NO: 6, 42) | KRAB-ZF3-ERT2 (SEQ ID NO: 7 or 43; SEQ ID NO: 378) |
|---|---|---|
| KRAB (72) | | 2-97; 2-97 |
| Linker (75) | | 100-105; 100-105 |
| ZF (2 or 76) | 2-177 | 110-285; 109-284 |
| p65 (69) | 181-374 | |
| Linker (73) | 374-378 | 288-292; 287-291 |
| Ert2 (74) | 379-692 | 292-606; 292-605 |

Table 5 shows the locations of specific domains in exemplary Self-Cleaving Protease Domain SynTFs polypeptide sequences.

TABLE 5

Exemplary Repressible Protease SynTFs

| Element (SEQ ID NO) | ZF10-p65-N53 (SEQ ID NO: 8, 44) | KRAB-N53-ZF10 (SEQ ID NO: 9, 45) |
|---|---|---|
| KRAB (72) | | 2-97 |
| ZF (3 or 76) | 2-177 | |
| 3XFlag-NLS (77) | 181-221 | 101-139 |
| Linker (75) | 222-227 | 142-147 |
| NS5A/5B cut site (CC) (78) | 230-239 | 150-159 |
| NS3 Domain (85) | 240-480 | 160-400 |
| N-end rule (79) | 236-243 | 156-163 |

TABLE 5-continued

Exemplary Repressible Protease SynTFs

| Element (SEQ ID NO) | ZF10-p65-N53 (SEQ ID NO: 8, 44) | KRAB-N53-ZF10 (SEQ ID NO: 9, 45) |
|---|---|---|
| AU1 (80) | 247-252 | 167-172 |
| NS4A (81) | 258-270 | 178-190 |
| NS3 (82) | 275-463 | 195-383 |
| NS4A/4B cut site (CS) (83) | 481-494 | 401-414 |
| HA tag (84) | 495-503 | 415-423 |
| Linker (75) | 504-509 | 424-429 |
| p65 (69) | 512-702 | 432-607 |

Tables 6 and 7 shows the locations of specific domains in exemplary Induced Degradation Domain SynTFs polypeptide sequences.

TABLE 6

Exemplary Induced Degradation Domain SynTFs (Activator Domain)

| Element (SEQ ID NO) | ZF3-p65-SMASh-ERT2- (SEQ ID NO: 10, 46) | SMASh-ZF3-p65-ERT2 (SEQ ID NO: 379; SEQ ID NOs: 11, 47) | ZF10-p65-SMASh (SEQ ID NO: 12 or 48) |
|---|---|---|---|
| 3XFlag-NLS (77) | | | 2-40 |
| Linker (75) | | | 43-48 |
| N-terminal SMASh (94 or 95) | | 2-298; 2-304 | |
| FLAG (89) | | 2-9; 2-9 | |
| Linker (90) | | 10-21; 10-21 | |
| NS3 protease (91) | | 22-207; 22-207 | |
| NS3 helicase (92) | | 208-240; 208-240 | |
| NS4A (93 or 96) | | 241-285; 241-291 | |
| NS3 5A/5B cleavage site (279) | | 286-298; 292-304 | |
| ZF (2, 3, or 76) | 2-177 | 301-474; 307-482 | 53-228 |
| p65 (69) | 181-371 | 480-670; 486-676 | 232-422 |
| Linker (73) | 374-378 | 673-677; 679-683 | |
| Ert2 (74) | 379-692 | 678-991; 684-997 | |
| C-terminal SMASh (86) | | 695-998 | 425-728 |
| NS3 cleavage site (87) | | 695-704 | 425-434 |
| linker (88) | | 705-714 | 435-444 |
| FLAG (89) | | 715-722 | 445-452 |
| linker (90) | | 723-734 | 453-464 |
| NS3 protease (91) | | 735-920 | 465-650 |
| NS3 helicase (92) | | 921-953 | 651-683 |
| NS4A (93) | | 954-998 | 684-728 |

TABLE 7

Exemplary Induced Degradation Domain SynTFs (Repressor Domain)

| Element (SEQ ID NO) | KRAB-ZF3-ERT2-SMASh (SEQ ID NO: 13, 49) | HPla-ZF3-ERT2-SMASh (SEQ ID NO: 14, 50) | EED-ZF3-ERT2-SMASh (SEQ ID NO: 15, 51) |
|---|---|---|---|
| KRAB (97) | 2-66 | | |
| HPla (98) | | 2-191 | |
| EED (99) | | | 2-441 |
| Linker (100) | 67-75 | 192-200 | 442-450 |
| ZF (2 or 76) | 76-251 | 201-376 | 451-626 |
| Linker (73) | 254-258 | 379-383 | 629-633 |
| Ert2 (74) | 259-572 | 384-697 | 634-947 |
| C-terminal SMASh (86) | 575-878 | 700-1003 | 950-1253 |
| NS3 cleavage site (87) | 575-584 | 700-709 | 950-959 |
| linker (88) | 585-594 | 710-719 | 960-969 |
| FLAG (89) | 595-602 | 720-727 | 970-977 |

TABLE 7-continued

Exemplary Induced Degradation Domain SynTFs (Repressor Domain)

| Element (SEQ ID NO) | KRAB-ZF3-ERT2-SMASh (SEQ ID NO: 13, 49) | HPla-ZF3-ERT2-SMASh (SEQ ID NO: 14, 50) | EED-ZF3-ERT2-SMASh (SEQ ID NO: 15, 51) |
|---|---|---|---|
| linker (90) | 603-614 | 728-739 | 978-989 |
| NS3 protease (91) | 615-800 | 740-925 | 990-1175 |
| NS3 helicase (92) | 801-833 | 926-958 | 1176-1208 |
| NS4A (93) | 834-878 | 959-1003 | 1209-1253 |

SEQUENCE LISTING (380 sequences)

SEQ ID NO: 1 - protein, 176 aa, Artificial Sequence
  synthetic polypeptide
SRPGERPFQCRICMRNFSEEANLRRHTRTHTGEKPFQCRICMRNFSDHSSLKRHLRTHTGSQKPFQCRICMRNFSQSANLLRHTRTHTGEKPFQCRICMRNFSDPSSLKRHLRTHTGSQKPFQCRICMRNFSQQTNLTRHTRTHTGEKPFQCRICMRNFSDATQLVRHLRTHLRGS

SEQ ID NO: 2 - protein, 176 aa, Artificial Sequence
  synthetic polypeptide
SRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGS

SEQ ID NO: 3 - protein, 176 aa, Artificial Sequence
  synthetic polypeptide
SRPGERPFQCRICMRNFSRRHGLDRHTRTHTGEKPFQCRICMRNFSDHSSLKRHLRTHTGSQKPFQCRICMRNFSVRHNLTRHLRTHTGEKPFQCRICMRNFSDHSNLSRHLKTHTGSQKPFQCRICMRNFSQRSSLVRHLRTHTGEKPFQCRICMRNFSESGHLKRHLRTHLRGS

SEQ ID NO: 4 - protein, 903 aa, Artificial Sequence
  synthetic polypeptide
  misc_feature (336)..(342): Xaa can be any naturally occurring amino acid
  misc_feature (364)..(370): Xaa can be any naturally occurring amino acid
  misc_feature (393)..(399): Xaa can be any naturally occurring amino acid
  misc_feature (421)..(427): Xaa can be any naturally occurring amino acid
  misc_feature (450)..(456): Xaa can be any naturally occurring amino acid
  misc_feature (478)..(484): Xaa can be any naturally occurring amino acid
MFEPKKKRKVFETSVPLYGFTSICGRRPEMEAAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKGGSGGSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSPKKKRKVTCRGSGATNFSLLKQAGDVEENPGPGHHDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSGGGSGQLTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMN

SEQ ID NO: 5 - protein, 808 aa, Artificial Sequence
  synthetic polypeptide
  misc_feature (336)..(342): Xaa can be any naturally occurring amino acid
  misc_feature (364)..(370): Xaa can be any naturally occurring amino acid
  misc_feature (393)..(399): Xaa can be any naturally occurring amino acid
  misc_feature (421)..(427): Xaa can be any naturally occurring amino acid
  misc_feature (450)..(456): Xaa can be any naturally occurring amino acid
  misc_feature (478)..(484): Xaa can be any naturally occurring amino acid
MFEPKKKRKVFETSVPLYGFTSICGRRPEMEAAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKGGSGGSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSTCRGSGATNFSLLKQAGDVEENPGPGHHPKKKRKVDAKSLTAWSRTLVTFKDVFVDFTREEWKLLDTAQQILYRNVMLENYKNLVSLGYQLTKPDVILRLEKGEEPWLVEREIHQETHPDSETAFEIKSSVGGGSGQLTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMN

SEQ ID NO: 6 - protein, 692 aa, Artificial Sequence
  synthetic polypeptide
  misc_feature (20)..(26): Xaa can be any naturally occurring amino acid
  misc_feature (48)..(54): Xaa can be any naturally occurring amino acid
  misc_feature (77)..(83): Xaa can be any naturally occurring amino acid
  misc_feature (105)..(111): Xaa can be any naturally occurring amino acid
  misc_feature (134)..(140): Xaa can be any naturally occurring amino acid
  misc_feature (162)..(168): Xaa can be any naturally occurring amino acid
MSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSTCRDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 7 - protein, 605 aa, Artificial Sequence
  synthetic polypeptide
  misc_feature (127)..(133): Xaa can be any naturally occurring amino acid
  misc_feature (155)..(161): Xaa can be any naturally occurring amino acid
  misc_feature (184)..(190): Xaa can be any naturally occurring amino acid
  misc_feature (212)..(218): Xaa can be any naturally occurring amino acid
  misc_feature (241)..(247): Xaa can be any naturally occurring amino acid
  misc_feature (269)..(275): Xaa can be any naturally occurring amino acid
MDAKSLTAWSRTLVTFKDVFVDFTREEWKLLDTAQQILYRNVMLENYKNLVSLGYQLTKPDVILRLEKGEEPWLVEREIHQETHPDSETAFEIKSSVLEGGGGSGTCRSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 8 - protein, 704 aa, Artificial Sequence
  synthetic polypeptide
  misc_feature (20)..(26): Xaa can be any naturally occurring amino acid
  misc_feature (48)..(54): Xaa can be any naturally occurring amino acid
  misc_feature (77)..(83): Xaa can be any naturally occurring amino acid
  misc_feature (105)..(111): Xaa can be any naturally occurring amino acid
  misc_feature (134)..(140): Xaa can be any naturally occurring amino acid
  misc_feature (162)..(168): Xaa can be any naturally occurring amino acid
MSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSTCRDYKDHDGDYKDHDIDYKDDDDKMAPKKKRKVGIHGVPGGLEGGGGSGGTEDVVCCHSIYGKKKGDIDTYRYIGSSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDREVLYQEFDEMEECSQHYPYDVPDYAGGGGSGGTDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSQL

SEQ ID NO: 9 - protein, 609 aa, Artificial Sequence
  synthetic polypeptide
  misc_feature (450)..(456): Xaa can be any naturally occurring amino acid
  misc_feature (478)..(484): Xaa can be any naturally occurring amino acid
  misc_feature (507)..(513): Xaa can be any naturally occurring amino acid
  misc_feature (535)..(541): Xaa can be any naturally occurring amino acid
  misc_feature (564)..(570): Xaa can be any naturally occurring amino acid
  misc_feature (592)..(598): Xaa can be any naturally occurring amino acid
MDAKSLTAWSRTLVTFKDVFVDFTREEWKLLDTAQQILYRNVMLENYKNLVSLGYQLTKPDVILRLEKGEEPWLVEREIHQETHPDSETAFEIKSSVTCRDYKDHDGDYKDHDIDYKDDDDKMAPKKKRKVGIHGVPGGLEGGGGSGGTEDVVCCHSIYGKKKGDIDTYRYIGSSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDREVLYQEFDEMEECSQHYPYDVPDYAGGGGSGGTSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSQL

SEQ ID NO: 10 - protein, 998 aa, Artificial Sequence
  synthetic polypeptide
  misc_feature (20)..(26): Xaa can be any naturally occurring amino acid
  misc_feature (48)..(54): Xaa can be any naturally occurring amino acid
  misc_feature (77)..(83): Xaa can be any naturally occurring amino acid
  misc_feature (105)..(111): Xaa can be any naturally occurring amino acid
  misc_feature (134)..(140): Xaa can be any naturally occurring amino acid
  misc_feature (162)..(168): Xaa can be any naturally occurring amino acid
MSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSTCRDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 11 - protein, 997 aa, Artificial Sequence
  synthetic polypeptide
  misc_feature (325)..(331): Xaa can be any naturally occurring amino acid
  misc_feature (353)..(359): Xaa can be any naturally occurring amino acid
  misc_feature (382)..(388): Xaa can be any naturally occurring amino acid
  misc_feature (410)..(416): Xaa can be any naturally occurring amino acid
  misc_feature (439)..(445): Xaa can be any naturally occurring amino acid
  misc_feature (467)..(473): Xaa can be any naturally occurring amino acid
MDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAGSSGSSIIPDREVLYQEFEDVVPCSMGSPGSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSTCRDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 12 - protein, 728 aa, Artificial Sequence
  synthetic polypeptide
  misc_feature (71)..(77): Xaa can be any naturally occurring amino acid
  misc_feature (99)..(105): Xaa can be any naturally occurring amino acid
  misc_feature (128)..(134): Xaa can be any naturally occurring amino acid
  misc_feature (156)..(162): Xaa can be any naturally occurring amino acid
  misc_feature (185)..(191): Xaa can be any naturally occurring amino acid
  misc_feature (213)..(219): Xaa can be any naturally occurring amino acid
MDYKDHDGDYKDHDIDYKDDDDKMAPKKKRKVGIHGVPGGLEGGGGSGGTASSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSTCRDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSPGDEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 13 - protein, 878 aa, Artificial Sequence
  synthetic polypeptide
  misc_feature (94)..(100): Xaa can be any naturally occurring amino acid
  misc_feature (122)..(128): Xaa can be any naturally occurring amino acid
  misc_feature (151)..(157): Xaa can be any naturally occurring amino acid
  misc_feature (179)..(185): Xaa can be any naturally occurring amino acid
  misc_feature (208)..(214): Xaa can be any naturally occurring amino acid
  misc_feature (236)..(242): Xaa can be any naturally occurring amino acid
MLAVSVTFEDVAVLFTRDEWKKLDLSQRSLYREVMLENYSNLASMAGFLFTKPKVISLLQQGEDPWGGSGSGSACSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 14 - protein, 1003 aa, Artificial Sequence
  synthetic polypeptide
  misc_feature (219)..(225): Xaa can be any naturally occurring amino acid
  misc_feature (247)..(253): Xaa can be any naturally occurring amino acid
  misc_feature (276)..(282): Xaa can be any naturally occurring amino acid
  misc_feature (304)..(310): Xaa can be any naturally occurring amino acid
  misc_feature (333)..(339): Xaa can be any naturally occurring amino acid
  misc_feature (361)..(367): Xaa can be any naturally occurring amino acid
MGKKTKRTADSSSSEDEEEYVVEKVLDRRVVKGQVEYLLKWKGFSEEHNTWEPEKNLDCPELISEFMKKYKKMKEGENNKPREKSESNKRKSNFSNSADDIKSKKKREQSNDIARGFERGLEPEKIIGATDSCGDLMFLMKWKDTDEADLVLAKEANVKCPQIVIAFYEERLTWHAYPEDAENKEKETAKSGGSGSGSACSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 15 - protein, 1253 aa, Artificial Sequence
  synthetic polypeptide
  misc_feature (469)..(475): Xaa can be any naturally occurring amino acid
  misc_feature (497)..(503): Xaa can be any naturally occurring amino acid
  misc_feature (526)..(532): Xaa can be any naturally occurring amino acid
  misc_feature (554)..(560): Xaa can be any naturally occurring amino acid
  misc_feature (583)..(589): Xaa can be any naturally occurring amino acid
  misc_feature (611)..(617): Xaa can be any naturally occurring amino acid
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLRGGSGSGSACSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 16 - DNA, 11661 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggttatggcaagctagctgcagtaacgccattattgcaaggcatggaaaaataccaaaccaagaatagagaagttcagatcaagggcgggtacatgaaaatagctaacgtagggccaaacaggatatctgcggtgagcagtttcggccccggcccggggccaagaacagatggtcaccgcagtttcggccccggcccgaggccaagagcagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggacgcgtttaattaagccgccaccatgttcgaacccaagaagaagagaaaggtgttcgaaactagtgtgcccctgtatggcttcacttccatttgtggccgacggcctgaaatggaagccgcggtgtcaaccataccacggtttctgcagagctcatcaggctccatgctggacggacgctttgatccacagtctgccgcacatttctttggagtctacgacggccacgggggcagccaggtcgccaactactgcagggaaaggatgcatttggcacttgccgaagagatcgccaaagagaagcccatgttgtgtgatggggatacctggctggagaagtggaagaaagcgctttttaactcttttctgagagtggattctgagatagaatctgtcgcacccgagaccgtgggcagcacatccgtcgtagccgtagtgtttccctcccacatattcgtcgccaactgcggcgacagtcgagccgtcctctgccgaggtaagaccgccctgcctctgagtgttgaccataagcccgaccgggaggatgaggccgcccgaatcgaggccgccggtggaaaagtcatccaatggaacggcgcaagagtgttcggcgtgctggcgatgtccaggagcattggagaccggtacctgaagcccagcataatcccagatcccgaagtgaccgcagtcaagagggtgaaagaggacgattgtctgatcctggctagcgatggcgtatgggacgtgatgactgatgaggaggcgtgtgaaatggcccgcaagcgaatcctgctgtggcataaaaaaaacgcagtcgcgggggacgcttctcttctggcagacgaaaggcgcaaagaaggtaaagacccggctgctatgagcgccgccgaatatctcagtaagctggcaattcagcgagggtccaaagacaacatttccgtggtcgtggtagacctcaaaggcggttccggcggttctagaccaggcgaacgaccgtttcaatgccggatatgtatgaggaacttctccgaggaggcaaacttgaggcgccacacccgaacacatacaggagaaaagccattccaatgtcgaatttgtatgcgcaatttttcagatcactcaagcctcaagcgacacctccgcacacatactggttcacagaagccctttcagtgcaggatttgtatgcgcaactttagccaatcagcgaaccttttgcggcacactagaacgcatacaggtgagaagcctttccagtgtcgcatctgtatgcggaacttcagcgaccccagttcattgaagaggcatttgcgaactcacaccggttctcaaaaaccttttcagtgccgaatttgtatgcgcaacttcagccaacaaacaaatttgacgagacacacgcgcacgcacaccggggaaaaaccgtttcaatgtcgaatctgcatgcgcaattttagcgatgcgacacaacttgttaggcatctgcgcacacacttgcggggatccccgaagaaaaaacggaaagtgacctgcaggggaagcggagctactaacttcagcctgctgaagcaggctggagacgtggaggagaaccctggacctggtcaccatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctccggtggtggcagcggtcaattgactcaagacgaattcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 17 - DNA, 11376 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggttatggcaagctagctgcagtaacgccattattgcaaggcatggaaaaataccaaaccaagaatagagaagttcagatcaagggcgggtacatgaaaatagctaacgtagggccaaacaggatatctgcggtgagcagtttcggccccggcccggggccaagaacagatggtcaccgcagtttcggccccggcccgaggccaagagcagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggacgcgtttaattaagccgccaccatgttcgaacccaagaagaagagaaaggtgttcgaaactagtgtgcccctgtatggcttcacttccatttgtggccgacggcctgaaatggaagccgcggtgtcaaccataccacggtttctgcagagctcatcaggctccatgctggacggacgctttgatccacagtctgccgcacatttctttggagtctacgacggccacgggggcagccaggtcgccaactactgcagggaaaggatgcatttggcacttgccgaagagatcgccaaagagaagcccatgttgtgtgatggggatacctggctggagaagtggaagaaagcgctttttaactcttttctgagagtggattctgagatagaatctgtcgcacccgagaccgtgggcagcacatccgtcgtagccgtagtgtttccctcccacatattcgtcgccaactgcggcgacagtcgagccgtcctctgccgaggtaagaccgccctgcctctgagtgttgaccataagcccgaccgggaggatgaggccgcccgaatcgaggccgccggtggaaaagtcatccaatggaacggcgcaagagtgttcggcgtgctggcgatgtccaggagcattggagaccggtacctgaagcccagcataatcccagatcccgaagtgaccgcagtcaagagggtgaaagaggacgattgtctgatcctggctagcgatggcgtatgggacgtgatgactgatgaggaggcgtgtgaaatggcccgcaagcgaatcctgctgtggcataaaaaaaacgcagtcgcgggggacgcttctcttctggcagacgaaaggcgcaaagaaggtaaagacccggctgctatgagcgccgccgaatatctcagtaagctggcaattcagcgagggtccaaagacaacatttccgtggtcgtggtagacctcaaaggcggttccggcggttctagaccaggcgaacgaccgtttcaatgccggatatgtatgaggaacttctccgaggaggcaaacttgaggcgccacacccgaacacatacaggagaaaagccattccaatgtcgaatttgtatgcgcaatttttcagatcactcaagcctcaagcgacacctccgcacacatactggttcacagaagccctttcagtgcaggatttgtatgcgcaactttagccaatcagcgaaccttttgcggcacactagaacgcatacaggtgagaagcctttccagtgtcgcatctgtatgcggaacttcagcgaccccagttcattgaagaggcatttgcgaactcacaccggttctcaaaaaccttttcagtgccgaatttgtatgcgcaacttcagccaacaaacaaatttgacgagacacacgcgcacgcacaccggggaaaaaccgtttcaatgtcgaatctgcatgcgcaattttagcgatgcgacacaacttgttaggcatctgcgcacacacttgcggggatccacctgcaggggaagcggagctactaacttcagcctgctgaagcaggctggagacgtggaggagaaccctggacctggtcaccatccgaagaaaaaacggaaagtggatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagttggtggtggcagcggtcaattgactcaagacgaattcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 18 - DNA, 11044 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatgtctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatccacctgcagggatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 19 - DNA, 10783 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatggatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagttctcgagggaggcggtggaagcggcacctgcaggtctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 20 - DNA, 11080 bp, Artificial Sequence
  synthetic vector
tctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatgtctagacccggagagcgcccattccagtgtcggatttgcatgcggaacttttcgagaagacacggcctggacagacatacccgtactcatacaggtgaaaaaccctttcagtgtcggatctgtatgcgaaatttctccgaccacagcagcctgaagagacatctacgtacccacaccggcagccagaagccatttcagtgtcggatctgtatgcggaacttctccgtgagacacaacctgaccagacatctacgtacgcacaccggagagaagccattccaatgccgaatatgcatgcgcaacttcagtgaccacagcaacctgagcagacacctaaaaacccacaccggttcccagaagccatttcagtgtcggatctgtatgcggaacttctcccagcgcagcagcctggtgagacatctacgtacgcacaccggagagaagccattccaatgccgaatatgcatgcgcaacttcagtgagagcggccacctgaagagacacctgcgtacgcacctgaggggatccacctgcagggactacaaagaccatgacggtgattataaagatcatgacatcgattacaaggatgacgatgacaagatggcccccaagaaaaagaggaaggtgggcattcacggggtgccgggtggactcgagggaggcggtggaagcggcggtaccgaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctggaggcggtggaagcggcggtaccgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccaattgtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataa

SEQ ID NO: 21 - DNA, 10795 bp, Artificial Sequence
  synthetic vector
tctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatggatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagttacctgcagggactacaaagaccatgacggtgattataaagatcatgacatcgattacaaggatgacgatgacaagatggcccccaagaaaaagaggaaggtgggcattcacggggtgccgggtggactcgagggaggcggtggaagcggcggtaccgaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctggaggcggtggaagcggcggtacctctagacccggagagcgcccattccagtgtcggatttgcatgcggaacttttcgagaagacacggcctggacagacatacccgtactcatacaggtgaaaaaccctttcagtgtcggatctgtatgcgaaatttctccgaccacagcagcctgaagagacatctacgtacccacaccggcagccagaagccatttcagtgtcggatctgtatgcggaacttctccgtgagacacaacctgaccagacatctacgtacgcacaccggagagaagccattccaatgccgaatatgcatgcgcaacttcagtgaccacagcaacctgagcagacacctaaaaacccacaccggttcccagaagccatttcagtgtcggatctgtatgcggaacttctcccagcgcagcagcctggtgagacatctacgtacgcacaccggagagaagccattccaatgccgaatatgcatgcgcaacttcagtgagagcggccacctgaagagacacctgcgtacgcacctgaggggatcccaattgtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataa

SEQ ID NO: 22 - DNA, 11962 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatgtctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatccacctgcagggatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccggggatgagatggaagagtgctctcagcacttacccggcgccggcagtagtggcgatatcatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctctgggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctactaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 23 - DNA, 11959 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaggcagtagcggaagcagtattatacctgacagggaggttctctaccaggagttcgaagatgtcgtgccatgctcaatgggctcgcccgggtctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatccacctgcagggatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 24 - DNA, 11128 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggttatggcaagctagctgcagtaacgccattattgcaaggcatggaaaaataccaaaccaagaatagagaagttcagatcaagggcgggtacatgaaaatagctaacgtagggccaaacaggatatctgcggtgagcagtttcggccccggcccggggccaagaacagatggtcaccgcagtttcggccccggcccgaggccaagagcagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggacgcgtgccgccaccatggactacaaagaccatgacggtgattataaagatcatgacatcgattacaaggatgacgatgacaagatggcccccaagaaaaagaggaaggtgggcattcacggggtgccgggtggactcgagggaggcggtggaagcggcggtaccgctagctctagacccggagagcgcccattccagtgtcggatttgcatgcggaacttttcgagaagacacggcctggacagacatacccgtactcatacaggtgaaaaaccctttcagtgtcggatctgtatgcgaaatttctccgaccacagcagcctgaagagacatctacgtacccacaccggcagccagaagccatttcagtgtcggatctgtatgcggaacttctccgtgagacacaacctgaccagacatctacgtacgcacaccggagagaagccattccaatgccgaatatgcatgcgcaacttcagtgaccacagcaacctgagcagacacctaaaaacccacaccggttcccagaagccatttcagtgtcggatctgtatgcggaacttctcccagcgcagcagcctggtgagacatctacgtacgcacaccggagagaagccattccaatgccgaatatgcatgcgcaacttcagtgagagcggccacctgaagagacacctgcgtacgcacctgaggggatccacctgcagggatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccccggggatgagatggaagagtgctctcagcacttacccggcgccggcagtagtggcgatatcatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctctgggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctactaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 25 - DNA, 11602 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatgctagcagtgtcagtgacatttgaagatgtggctgtgctctttactcgggacgagtggaagaagctggatctgtctcagagaagcctgtaccgtgaggtgatgctggagaattacagcaacctggcctccatggcaggattcctgtttaccaaaccaaaggtgatctccctgttgcagcaaggagaggatccctgggggggtagcggcagcggtagcgcatgctctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccggggatgagatggaagagtgctctcagcacttacccggcgccggcagtagtggcgatatcatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctctgggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctactaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 26 - DNA, 11977 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatgggaaagaaaaccaagcggacagctgacagttcttcttcagaggatgaggaggagtatgtcgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagcgggggtagcggcagcggtagcgcatgctctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccggggatgagatggaagagtgctctcagcacttacccggcgccggcagtagtggcgatatcatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctctgggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctactaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 27 - DNA, 12727 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatgtccgagagggaagtgtcgactgcgccggcgggaacagacatgcccgcggccaagaagcagaagttgagcagcgacgagaacagcaacccggacctctcgggagacgaaaatgacgatgctgtcagtattgagagtggcacaaacacagaacgcccggacacgcccacaaatacgccaaatgcaccaggaaggaaaagctggggaaagggaaaatggaagtcaaagaaatgcaaatattctttcaaatgtgtgaacagcctcaaggaagatcataaccagccattgtttggagttcagtttaactggcacagtaaagaaggagaccctctggtgtttgcaactgtgggaagcaacagagtaaccttatacgaatgccattcacagggggagatacggttattgcagtcctatgtagatgctgatgcagatgaaaacttttacacttgtgcatggacctatgatagcaacaccagccaccctctattagcagttgctggatctagaggcattataagaataattaatcctataacaatgcagtgtataaagcactatgttggccatggaaatgctatcaatgagctgaaattccacccacgagacccaaaccttctcctgtcagtaagtaaagatcatgctttacggttatggaatatccaaacagacactcttgtggcaatattcggaggtgtggaagggcacagagatgaagttctgagtgctgattatgatcttttgggtgaaaaaataatgtcctgtggtatggatcactctcttaaactgtggagaatcaactcaaagaggatgatgaatgcaattaaggagtcttatgattataacccaaacaaaactaacaggccatttatttcccagaaaatccactttcctgacttttctaccagagacatacataggaattatgttgattgtgtgcgatggttaggcgatttgatactttccaagtcttgtgaaaatgccattgtatgctggaaacctggcaaaatggaggatgatatagataaaattaaacctagtgagtctaatgtgactattcttgggcgatttgattacagccagtgtgacatttggtacatgaggttttctatggatttctggcaaaagatgcttgcattgggcaatcaggttggcaaactgtatgtttgggatttagaagtagaagatcctcataaagccaaatgcacaacactgacccatcataaatgtggcgcggctattcgacaaaccagtttcagtagggatagcagcatcctcatagctgtctgcgatgatgccagcatttggcgctgggatcgacttcgagggggtagcggcagcggtagcgcatgctctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccggggatgagatggaagagtgctctcagcacttacccggcgccggcagtagtggcgatatcatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctctgggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctactaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 28 - DNA, 2712 bp, Artificial Sequence
  synthetic polynucleotide
atgttcgaacccaagaagaagagaaaggtgttcgaaactagtgtgcccctgtatggcttcacttccatttgtggccgacggcctgaaatggaagccgcggtgtcaaccataccacggtttctgcagagctcatcaggctccatgctggacggacgctttgatccacagtctgccgcacatttctttggagtctacgacggccacgggggcagccaggtcgccaactactgcagggaaaggatgcatttggcacttgccgaagagatcgccaaagagaagcccatgttgtgtgatggggatacctggctggagaagtggaagaaagcgctttttaactcttttctgagagtggattctgagatagaatctgtcgcacccgagaccgtgggcagcacatccgtcgtagccgtagtgtttccctcccacatattcgtcgccaactgcggcgacagtcgagccgtcctctgccgaggtaagaccgccctgcctctgagtgttgaccataagcccgaccgggaggatgaggccgcccgaatcgaggccgccggtggaaaagtcatccaatggaacggcgcaagagtgttcggcgtgctggcgatgtccaggagcattggagaccggtacctgaagcccagcataatcccagatcccgaagtgaccgcagtcaagagggtgaaagaggacgattgtctgatcctggctagcgatggcgtatgggacgtgatgactgatgaggaggcgtgtgaaatggcccgcaagcgaatcctgctgtggcataaaaaaaacgcagtcgcgggggacgcttctcttctggcagacgaaaggcgcaaagaaggtaaagacccggctgctatgagcgccgccgaatatctcagtaagctggcaattcagcgagggtccaaagacaacatttccgtggtcgtggtagacctcaaaggcggttccggcggttctagaccaggcgaacgaccgtttcaatgccggatatgtatgaggaacttctccgaggaggcaaacttgaggcgccacacccgaacacatacaggagaaaagccattccaatgtcgaatttgtatgcgcaatttttcagatcactcaagcctcaagcgacacctccgcacacatactggttcacagaagccctttcagtgcaggatttgtatgcgcaactttagccaatcagcgaaccttttgcggcacactagaacgcatacaggtgagaagcctttccagtgtcgcatctgtatgcggaacttcagcgaccccagttcattgaagaggcatttgcgaactcacaccggttctcaaaaaccttttcagtgccgaatttgtatgcgcaacttcagccaacaaacaaatttgacgagacacacgcgcacgcacaccggggaaaaaccgtttcaatgtcgaatctgcatgcgcaattttagcgatgcgacacaacttgttaggcatctgcgcacacacttgcggggatccccgaagaaaaaacggaaagtgacctgcaggggaagcggagctactaacttcagcctgctgaagcaggctggagacgtggaggagaaccctggacctggtcaccatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctccggtggtggcagcggtcaattgactcaagacgaattcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactaa

SEQ ID NO: 29 - DNA, 2427 bp, Artificial Sequence
  synthetic polynucleotide
atgttcgaacccaagaagaagagaaaggtgttcgaaactagtgtgcccctgtatggcttcacttccatttgtggccgacggcctgaaatggaagccgcggtgtcaaccataccacggtttctgcagagctcatcaggctccatgctggacggacgctttgatccacagtctgccgcacatttctttggagtctacgacggccacgggggcagccaggtcgccaactactgcagggaaaggatgcatttggcacttgccgaagagatcgccaaagagaagcccatgttgtgtgatggggatacctggctggagaagtggaagaaagcgctttttaactcttttctgagagtggattctgagatagaatctgtcgcacccgagaccgtgggcagcacatccgtcgtagccgtagtgtttccctcccacatattcgtcgccaactgcggcgacagtcgagccgtcctctgccgaggtaagaccgccctgcctctgagtgttgaccataagcccgaccgggaggatgaggccgcccgaatcgaggccgccggtggaaaagtcatccaatggaacggcgcaagagtgttcggcgtgctggcgatgtccaggagcattggagaccggtacctgaagcccagcataatcccagatcccgaagtgaccgcagtcaagagggtgaaagaggacgattgtctgatcctggctagcgatggcgtatgggacgtgatgactgatgaggaggcgtgtgaaatggcccgcaagcgaatcctgctgtggcataaaaaaaacgcagtcgcgggggacgcttctcttctggcagacgaaaggcgcaaagaaggtaaagacccggctgctatgagcgccgccgaatatctcagtaagctggcaattcagcgagggtccaaagacaacatttccgtggtcgtggtagacctcaaaggcggttccggcggttctagaccaggcgaacgaccgtttcaatgccggatatgtatgaggaacttctccgaggaggcaaacttgaggcgccacacccgaacacatacaggagaaaagccattccaatgtcgaatttgtatgcgcaatttttcagatcactcaagcctcaagcgacacctccgcacacatactggttcacagaagccctttcagtgcaggatttgtatgcgcaactttagccaatcagcgaaccttttgcggcacactagaacgcatacaggtgagaagcctttccagtgtcgcatctgtatgcggaacttcagcgaccccagttcattgaagaggcatttgcgaactcacaccggttctcaaaaaccttttcagtgccgaatttgtatgcgcaacttcagccaacaaacaaatttgacgagacacacgcgcacgcacaccggggaaaaaccgtttcaatgtcgaatctgcatgcgcaattttagcgatgcgacacaacttgttaggcatctgcgcacacacttgcggggatccacctgcaggggaagcggagctactaacttcagcctgctgaagcaggctggagacgtggaggagaaccctggacctggtcaccatccgaagaaaaaacggaaagtggatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagttggtggtggcagcggtcaattgactcaagacgaattcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactaa

SEQ ID NO: 30 - DNA, 2079 bp, Artificial Sequence
  synthetic polynucleotide
atgtctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatccacctgcagggatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttaa

SEQ ID NO: 31 - DNA, 1818 bp, Artificial Sequence
  synthetic polynucleotide
atggatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagttctcgagggaggcggtggaagcggcacctgcaggtctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttaa

SEQ ID NO: 32 - DNA, 2115 bp, Artificial Sequence
  synthetic polynucleotide
atgtctagacccggagagcgcccattccagtgtcggatttgcatgcggaacttttcgagaagacacggcctggacagacatacccgtactcatacaggtgaaaaaccctttcagtgtcggatctgtatgcgaaatttctccgaccacagcagcctgaagagacatctacgtacccacaccggcagccagaagccatttcagtgtcggatctgtatgcggaacttctccgtgagacacaacctgaccagacatctacgtacgcacaccggagagaagccattccaatgccgaatatgcatgcgcaacttcagtgaccacagcaacctgagcagacacctaaaaacccacaccggttcccagaagccatttcagtgtcggatctgtatgcggaacttctcccagcgcagcagcctggtgagacatctacgtacgcacaccggagagaagccattccaatgccgaatatgcatgcgcaacttcagtgagagcggccacctgaagagacacctgcgtacgcacctgaggggatccacctgcagggactacaaagaccatgacggtgattataaagatcatgacatcgattacaaggatgacgatgacaagatggcccccaagaaaaagaggaaggtgggcattcacggggtgccgggtggactcgagggaggcggtggaagcggcggtaccgaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctggaggcggtggaagcggcggtaccgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccaattgtaa

SEQ ID NO: 33 - DNA, 1830 bp, Artificial Sequence
  synthetic polynucleotide
atggatgctaagtcactgactgcctggtcccggacactggtgaccttcaaggatgtgtttgtggacttcaccagggaggagtggaagctgctggacactgctcagcagatcctgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagttacctgcagggactacaaagaccatgacggtgattataaagatcatgacatcgattacaaggatgacgatgacaagatggcccccaagaaaaagaggaaggtgggcattcacggggtgccgggtggactcgagggaggcggtggaagcggcggtaccgaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctggaggcggtggaagcggcggtacctctagacccggagagcgcccattccagtgtcggatttgcatgcggaacttttcgagaagacacggcctggacagacatacccgtactcatacaggtgaaaaaccctttcagtgtcggatctgtatgcgaaatttctccgaccacagcagcctgaagagacatctacgtacccacaccggcagccagaagccatttcagtgtcggatctgtatgcggaacttctccgtgagacacaacctgaccagacatctacgtacgcacaccggagagaagccattccaatgccgaatatgcatgcgcaacttcagtgaccacagcaacctgagcagacacctaaaaacccacaccggttcccagaagccatttcagtgtcggatctgtatgcggaacttctcccagcgcagcagcctggtgagacatctacgtacgcacaccggagagaagccattccaatgccgaatatgcatgcgcaacttcagtgagagcggccacctgaagagacacctgcgtacgcacctgaggggatcccaattgtaa

SEQ ID NO: 34 - DNA, 2997 bp, Artificial Sequence
  synthetic polynucleotide
atgtctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatccacctgcagggatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccggggatgagatggaagagtgctctcagcacttacccggcgccggcagtagtggcgatatcatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctctgggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctactaa

SEQ ID NO: 35 - DNA, 2994 bp, Artificial Sequence
  synthetic polynucleotide
atggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaggcagtagcggaagcagtattatacctgacagggaggttctctaccaggagttcgaagatgtcgtgccatgctcaatgggctcgcccgggtctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatccacctgcagggatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagcttaa

SEQ ID NO: 36 - DNA, 2187 bp, Artificial Sequence
  synthetic polynucleotide
atggactacaaagaccatgacggtgattataaagatcatgacatcgattacaaggatgacgatgacaagatggcccccaagaaaaagaggaaggtgggcattcacggggtgccgggtggactcgagggaggcggtggaagcggcggtaccgctagctctagacccggagagcgcccattccagtgtcggatttgcatgcggaacttttcgagaagacacggcctggacagacatacccgtactcatacaggtgaaaaaccctttcagtgtcggatctgtatgcgaaatttctccgaccacagcagcctgaagagacatctacgtacccacaccggcagccagaagccatttcagtgtcggatctgtatgcggaacttctccgtgagacacaacctgaccagacatctacgtacgcacaccggagagaagccattccaatgccgaatatgcatgcgcaacttcagtgaccacagcaacctgagcagacacctaaaaacccacaccggttcccagaagccatttcagtgtcggatctgtatgcggaacttctcccagcgcagcagcctggtgagacatctacgtacgcacaccggagagaagccattccaatgccgaatatgcatgcgcaacttcagtgagagcggccacctgaagagacacctgcgtacgcacctgaggggatccacctgcagggatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccccggggatgagatggaagagtgctctcagcacttacccggcgccggcagtagtggcgatatcatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctctgggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctactaa

SEQ ID NO: 37 - DNA, 2637 bp, Artificial Sequence
  synthetic polynucleotide
atgctagcagtgtcagtgacatttgaagatgtggctgtgctctttactcgggacgagtggaagaagctggatctgtctcagagaagcctgtaccgtgaggtgatgctggagaattacagcaacctggcctccatggcaggattcctgtttaccaaaccaaaggtgatctccctgttgcagcaaggagaggatccctgggggggtagcggcagcggtagcgcatgctctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccggggatgagatggaagagtgctctcagcacttacccggcgccggcagtagtggcgatatcatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctctgggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctactaa

SEQ ID NO: 38 - DNA, 3012 bp, Artificial Sequence
  synthetic polynucleotide
atgggaaagaaaaccaagcggacagctgacagttcttcttcagaggatgaggaggagtatgtcgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagcgggggtagcggcagcggtagcgcatgctctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccggggatgagatggaagagtgctctcagcacttacccggcgccggcagtagtggcgatatcatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctctgggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctactaa

SEQ ID NO: 39 - DNA, 3762 bp, Artificial Sequence
  synthetic polynucleotide
atgtccgagagggaagtgtcgactgcgccggcgggaacagacatgcccgcggccaagaagcagaagttgagcagcgacgagaacagcaacccggacctctcgggagacgaaaatgacgatgctgtcagtattgagagtggcacaaacacagaacgcccggacacgcccacaaatacgccaaatgcaccaggaaggaaaagctggggaaagggaaaatggaagtcaaagaaatgcaaatattctttcaaatgtgtgaacagcctcaaggaagatcataaccagccattgtttggagttcagtttaactggcacagtaaagaaggagaccctctggtgtttgcaactgtgggaagcaacagagtaaccttatacgaatgccattcacagggggagatacggttattgcagtcctatgtagatgctgatgcagatgaaaacttttacacttgtgcatggacctatgatagcaacaccagccaccctctattagcagttgctggatctagaggcattataagaataattaatcctataacaatgcagtgtataaagcactatgttggccatggaaatgctatcaatgagctgaaattccacccacgagacccaaaccttctcctgtcagtaagtaaagatcatgctttacggttatggaatatccaaacagacactcttgtggcaatattcggaggtgtggaagggcacagagatgaagttctgagtgctgattatgatcttttgggtgaaaaaataatgtcctgtggtatggatcactctcttaaactgtggagaatcaactcaaagaggatgatgaatgcaattaaggagtcttatgattataacccaaacaaaactaacaggccatttatttcccagaaaatccactttcctgacttttctaccagagacatacataggaattatgttgattgtgtgcgatggttaggcgatttgatactttccaagtcttgtgaaaatgccattgtatgctggaaacctggcaaaatggaggatgatatagataaaattaaacctagtgagtctaatgtgactattcttgggcgatttgattacagccagtgtgacatttggtacatgaggttttctatggatttctggcaaaagatgcttgcattgggcaatcaggttggcaaactgtatgtttgggatttagaagtagaagatcctcataaagccaaatgcacaacactgacccatcataaatgtggcgcggctattcgacaaaccagtttcagtagggatagcagcatcctcatagctgtctgcgatgatgccagcatttggcgctgggatcgacttcgagggggtagcggcagcggtagcgcatgctctagaccaggcgaacgaccgtttcaatgccggatatgtatgaggaacttctcccagaggtccagcttggtacggcacacccgaacacatacaggagaaaagccattccaatgtcgaatttgtatgcgcaatttttcagacaagtctgtgttggctcgacacctccgcacacatactggttcacagaagccctttcagtgcaggatttgtatgcgcaactttagccaacgctcatccctggtaaggcacactagaacgcatacaggtgagaagcctttccagtgtcgcatctgtatgcggaacttcagccagcggaataacttgggcaggcatttgcgaactcacaccggttctcaaaaaccttttcagtgccgaatttgtatgcgcaacttcagcacccacgccgtattgacacgacacacgcgcacgcacaccggggaaaaaccgtttcaatgtcgaatctgcatgcgcaattttagcgatagagggaacctcactcgacatctgcgcacacacttgcggggatcccaattgtgcgtacgcggatcctctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggaggcggcggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagctcccggggatgagatggaagagtgctctcagcacttacccggcgccggcagtagtggcgatatcatggattacaaggatgacgacgataagggctcttccgggacaggctccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctctgggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgataccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctactaa

SEQ ID NO: 40 - protein, 903 aa, Artificial Sequence
  synthetic polypeptide
MFEPKKKRKVFETSVPLYGFTSICGRRPEMEAAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKGGSGGSRPGERPFQCRICMRNFSEEANLRRHTRTHTGEKPFQCRICMRNFSDHSSLKRHLRTHTGSQKPFQCRICMRNFSQSANLLRHTRTHTGEKPFQCRICMRNFSDPSSLKRHLRTHTGSQKPFQCRICMRNFSQQTNLTRHTRTHTGEKPFQCRICMRNFSDATQLVRHLRTHLRGSPKKKRKVTCRGSGATNFSLLKQAGDVEENPGPGHHDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSGGGSGQLTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMN

SEQ ID NO: 41 - protein, 808 aa, Artificial Sequence
  synthetic polypeptide
MFEPKKKRKVFETSVPLYGFTSICGRRPEMEAAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKGGSGGSRPGERPFQCRICMRNFSEEANLRRHTRTHTGEKPFQCRICMRNFSDHSSLKRHLRTHTGSQKPFQCRICMRNFSQSANLLRHTRTHTGEKPFQCRICMRNFSDPSSLKRHLRTHTGSQKPFQCRICMRNFSQQTNLTRHTRTHTGEKPFQCRICMRNFSDATQLVRHLRTHLRGSTCRGSGATNFSLLKQAGDVEENPGPGHHPKKKRKVDAKSLTAWSRTLVTFKDVFVDFTREEWKLLDTAQQILYRNVMLENYKNLVSLGYQLTKPDVILRLEKGEEPWLVEREIHQETHPDSETAFEIKSSVGGGSGQLTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMN

SEQ ID NO: 42 - protein, 692 aa, Artificial Sequence
  synthetic polypeptide
MSRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGSTCRDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 43 - protein, 605 aa, Artificial Sequence
  synthetic polypeptide
MDAKSLTAWSRTLVTFKDVFVDFTREEWKLLDTAQQILYRNVMLENYKNLVSLGYQLTKPDVILRLEKGEEPWLVEREIHQETHPDSETAFEIKSSVLEGGGGSGTCRSRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 44 - protein, 704 aa, Artificial Sequence
  synthetic polypeptide
MSRPGERPFQCRICMRNFSRRHGLDRHTRTHTGEKPFQCRICMRNFSDHSSLKRHLRTHTGSQKPFQCRICMRNFSVRHNLTRHLRTHTGEKPFQCRICMRNFSDHSNLSRHLKTHTGSQKPFQCRICMRNFSQRSSLVRHLRTHTGEKPFQCRICMRNFSESGHLKRHLRTHLRGSTCRDYKDHDGDYKDHDIDYKDDDDKMAPKKKRKVGIHGVPGGLEGGGGSGGTEDVVCCHSIYGKKKGDIDTYRYIGSSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDREVLYQEFDEMEECSQHYPYDVPDYAGGGGSGGTDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSQL

SEQ ID NO: 45 - protein, 609 aa, Artificial Sequence
  synthetic polypeptide
MDAKSLTAWSRTLVTFKDVFVDFTREEWKLLDTAQQILYRNVMLENYKNLVSLGYQLTKPDVILRLEKGEEPWLVEREIHQETHPDSETAFEIKSSVTCRDYKDHDGDYKDHDIDYKDDDDKMAPKKKRKVGIHGVPGGLEGGGGSGGTEDVVCCHSIYGKKKGDIDTYRYIGSSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDREVLYQEFDEMEECSQHYPYDVPDYAGGGGSGGTSRPGERPFQCRICMRNFSRRHGLDRHTRTHTGEKPFQCRICMRNFSDHSSLKRHLRTHTGSQKPFQCRICMRNFSVRHNLTRHLRTHTGEKPFQCRICMRNFSDHSNLSRHLKTHTGSQKPFQCRICMRNFSQRSSLVRHLRTHTGEKPFQCRICMRNFSESGHLKRHLRTHLRGSQL

SEQ ID NO: 46 - protein, 998 aa, Artificial Sequence
  synthetic polypeptide
MSRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGSTCRDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 47 - protein, 997 aa, Artificial Sequence
  synthetic polypeptide
MDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAGSSGSSIIPDREVLYQEFEDVVPCSMGSPGSRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGSTCRDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 48 - protein, 728 aa, Artificial Sequence
  synthetic polypeptide
MDYKDHDGDYKDHDIDYKDDDDKMAPKKKRKVGIHGVPGGLEGGGGSGGTASSRPGERPFQCRICMRNFSRRHGLDRHTRTHTGEKPFQCRICMRNFSDHSSLKRHLRTHTGSQKPFQCRICMRNFSVRHNLTRHLRTHTGEKPFQCRICMRNFSDHSNLSRHLKTHTGSQKPFQCRICMRNFSQRSSLVRHLRTHTGEKPFQCRICMRNFSESGHLKRHLRTHLRGSTCRDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSPGDEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 49 - protein, 878 aa, Artificial Sequence
  synthetic polypeptide
MLAVSVTFEDVAVLFTRDEWKKLDLSQRSLYREVMLENYSNLASMAGFLFTKPKVISLLQQGEDPWGGSGSGSACSRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 50 - protein, 1003 aa, Artificial Sequence
  synthetic polypeptide
MGKKTKRTADSSSSEDEEEYVVEKVLDRRVVKGQVEYLLKWKGFSEEHNTWEPEKNLDCPELISEFMKKYKKMKEGENNKPREKSESNKRKSNFSNSADDIKSKKKREQSNDIARGFERGLEPEKIIGATDSCGDLMFLMKWKDTDEADLVLAKEANVKCPQIVIAFYEERLTWHAYPEDAENKEKETAKSGGSGSGSACSRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 51 - protein, 1253 aa, Artificial Sequence
  synthetic polypeptide
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLRGGSGSGSACSRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATAPGDEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 52 - DNA, 9439 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattccgggtttcgtaacaatcgcatgaggattcgcaacgccttcgtcgaagtcgaagtcgacctcccgtctcagtaaaggtcgtcgaagtcgaagtcgaccaatcggactgccttcgtacgtcgaagtcgaagtcgaccgtatcagtcgcctcggaacgtcgaagtcgaagtcgaccattcgtaagaggctcactctcccttacacggagtggataactagttaggcgtgtacggtgggaggcctatataagcagagctcgtttagtgaaccgtcagatcgcctggaacgcgtaccggtgtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctggcaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 53 - DNA, 9439 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattccgggtttcgtaacaatcgcatgaggattcgcaacgccttagacgtcgaagtagccgtagtcccgtctcagtaaaggtagacgtcgaagtagccgtagaatcggactgccttcgtaagacgtcgaagtagccgtaggtatcagtcgcctcggaaagacgtcgaagtagccgtagattcgtaagaggctcactctcccttacacggagtggataactagttaggcgtgtacggtgggaggcctatataagcagagctcgtttagtgaaccgtcagatcgcctggaacgcgtaccggtgtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctggcaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 54 - DNA, 9439 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattccgggtttcgtaacaatcgcatgaggattcgcaacgccttcggcgtagccgatgtcgcgctcccgtctcagtaaaggtcggcgtagccgatgtcgcgcaatcggactgccttcgtacggcgtagccgatgtcgcgcgtatcagtcgcctcggaacggcgtagccgatgtcgcgcattcgtaagaggctcactctcccttacacggagtggataactagttaggcgtgtacggtgggaggcctatataagcagagctcgtttagtgaaccgtcagatcgcctggaacgcgtaccggtgtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctggcaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 55 - DNA, 10091 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattccgggtttcgtaacaatcgcatgaggattcgcaacgccttcgtcgaagtcgaagtcgacctcccgtctcagtaaaggtcgtcgaagtcgaagtcgaccaatcggactgccttcgtacgtcgaagtcgaagtcgaccgtatcagtcgcctcggaacgtcgaagtcgaagtcgaccattcgtaagaggctcactctcccttacacggagtggataactagtgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcacgcgtaccggtgtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctggcaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagaagcttagccatggcttcccgccggaggtggaggagcaggatgatggcacgctgcccatgtcttgtgcccaggagagcgggatggaccgtcaccctgcagcctgtgcttctgctaggatcaatgtgtagtaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 56 - DNA, 10091 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattccgggtttcgtaacaatcgcatgaggattcgcaacgccttagacgtcgaagtagccgtagtcccgtctcagtaaaggtagacgtcgaagtagccgtagaatcggactgccttcgtaagacgtcgaagtagccgtaggtatcagtcgcctcggaaagacgtcgaagtagccgtagattcgtaagaggctcactctcccttacacggagtggataactagtgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcacgcgtaccggtgtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctggcaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagaagcttagccatggcttcccgccggaggtggaggagcaggatgatggcacgctgcccatgtcttgtgcccaggagagcgggatggaccgtcaccctgcagcctgtgcttctgctaggatcaatgtgtagtaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 57 - DNA, 10091 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattccgggtttcgtaacaatcgcatgaggattcgcaacgccttcggcgtagccgatgtcgcgctcccgtctcagtaaaggtcggcgtagccgatgtcgcgcaatcggactgccttcgtacggcgtagccgatgtcgcgcgtatcagtcgcctcggaacggcgtagccgatgtcgcgcattcgtaagaggctcactctcccttacacggagtggataactagtgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcacgcgtaccggtgtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctggcaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagaagcttagccatggcttcccgccggaggtggaggagcaggatgatggcacgctgcccatgtcttgtgcccaggagagcgggatggaccgtcaccctgcagcctgtgcttctgctaggatcaatgtgtagtaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 58 - DNA, 9868 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattccgggtttcgtaacaatcgcatgaggattcgcaacgccttcgtcgaagtcgaagtcgacctcccgtctcagtaaaggtcgtcgaagtcgaagtcgaccaatcggactgccttcgtacgtcgaagtcgaagtcgaccgtatcagtcgcctcggaacgtcgaagtcgaagtcgaccattcgtaagaggctcactctcccttacacggagtggataactagtccgataaaataaaagattttatttagtctccagaaaaaggggggaatgaaagaccccacctgtaggttatggcaagctagctgcagtaacgccattattgcaaggcatggaaaaataccaaaccaagaatagagaagttcagatcaagggcgggtacatgaaaatagctaacgtagggccaaacaggatatctgcggtgagcagtttcggccccggcccggggccaagaacagatggtcaccgcagtttcggccccggcccgaggccaagagcagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggacgcgtaccggtgtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctggcaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 59 - DNA, 9868 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattccgggtttcgtaacaatcgcatgaggattcgcaacgccttagacgtcgaagtagccgtagtcccgtctcagtaaaggtagacgtcgaagtagccgtagaatcggactgccttcgtaagacgtcgaagtagccgtaggtatcagtcgcctcggaaagacgtcgaagtagccgtagattcgtaagaggctcactctcccttacacggagtggataactagtccgataaaataaaagattttatttagtctccagaaaaaggggggaatgaaagaccccacctgtaggttatggcaagctagctgcagtaacgccattattgcaaggcatggaaaaataccaaaccaagaatagagaagttcagatcaagggcgggtacatgaaaatagctaacgtagggccaaacaggatatctgcggtgagcagtttcggccccggcccggggccaagaacagatggtcaccgcagtttcggccccggcccgaggccaagagcagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggacgcgtaccggtgtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctggcaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 60 - DNA, 9868 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattccgggtttcgtaacaatcgcatgaggattcgcaacgccttcggcgtagccgatgtcgcgctcccgtctcagtaaaggtcggcgtagccgatgtcgcgcaatcggactgccttcgtacggcgtagccgatgtcgcgcgtatcagtcgcctcggaacggcgtagccgatgtcgcgcattcgtaagaggctcactctcccttacacggagtggataactagtccgataaaataaaagattttatttagtctccagaaaaaggggggaatgaaagaccccacctgtaggttatggcaagctagctgcagtaacgccattattgcaaggcatggaaaaataccaaaccaagaatagagaagttcagatcaagggcgggtacatgaaaatagctaacgtagggccaaacaggatatctgcggtgagcagtttcggccccggcccggggccaagaacagatggtcaccgcagtttcggccccggcccgaggccaagagcagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggacgcgtaccggtgtcgccaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctggcaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 61 - DNA, 11090 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcgtcgaccgggtttcgtaacaatcgcatgaggattcgcaacgccttcggcgtagccgatgtcgcgctcccgtctcagtaaaggtcggcgtagccgatgtcgcgcaatcggactgccttcgtacggcgtagccgatgtcgcgcgtatcagtcgcctcggaacggcgtagccgatgtcgcgcattcgtaagaggctcactctcccttacacggagtggataactagtttcgcatattaaggtgacgcgtgtggcctcgaacaccgagcgaccctgcagcgacccgcttaaggatccaccggtcgccaccacacatacacagaaatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggcggcaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagaacaaaaactcatctcagaagaagatctgaatggggccgcaaccacgacgccagcgccgcgaccaccaacaccggcgcccaccatcgcgttgcagcccctgtccctgcgcccagaggcgtgccggccagcggcggggggcgcagtgcacacgagggggctggacttcgcctgtgatttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 62 - DNA, 10333 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattccgggtttcgtaacaatcgcatgaggattcgcaacgccttagacgtcgaagtagccgtagtcccgtctcagtaaaggtagacgtcgaagtagccgtagaatcggactgccttcgtaagacgtcgaagtagccgtaggtatcagtcgcctcggaaagacgtcgaagtagccgtagattcgtaagaggctcactctcccttacacggagtggataactagttaggcgtgtacggtgggaggcctatataagcagagctcgtttagtgaaccgtcagatcgcctggaacgcgtaccggtgtcgccaccatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagcctcgagggcggcggagagggcagaggaagtcttctaacatgcggtgacgtggaggagaatcccggccctaggatgcttctcctggtgacaagccttctgctctgtgagttaccacacccagcattcctcctgatcccacgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgtgaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 63 - DNA, 9281 bp, Artificial Sequence
  synthetic vector
cgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcgtcgaccgggtttcgtaacaatcgcatgaggattcgcaacgccttcggcgtagccgatgtcgcgctcccgtctcagtaaaggtcggcgtagccgatgtcgcgcaatcggactgccttcgtacggcgtagccgatgtcgcgcgtatcagtcgcctcggaacggcgtagccgatgtcgcgcattcgtaagaggctcactctcccttacacggagtggataactagtttcgcatattaaggtgacgcgtgtggcctcgaacaccgagcgaccctgcagcgacccgcttaaggatccaccggtcgccaccacacatacacagaaatgcactcatctgctctcctttgctgtctcgtgctcctgactggagtacgcgcgtcacccggtcaagggacacaaagcgaaaactcctgtacgcattttccgggcaacctccctaatatgcttcgcgacttgcgagatgcattttccagggtgaagaccttcttccagatgaaggaccagttggataatcttctcctcaaggagtctcttttggaggacttcaagggctacctgggatgtcaagcccttagcgaaatgattcagttttatcttgaagaggtcatgccgcaagctgagaaccaggaccccgacataaaagcccatgtgaactccctcggcgagaatttgaagacgctgagacttagattgagaagatgtcatagatttctcccatgtgagaataagtccaaggctgtcgagcaggttaagaatgctttcaataagttgcaggaaaaaggaatctataaggcaatgagcgagtttgacatctttattaactacattgaggcttatatgactatgaaaattagaaactaaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 64 - DNA, 11931 bp, Artificial Sequence
  synthetic vector
tctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctgtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaatcttttcaacgcctggcactgccgggcgttgttctttttaacttcaggcgggttacaatagtttccagtaagtattctggaggctgcatccatgacacaggcaaacctgagcgaaaccctgttcaaaccccgctttaaacatcctgaaacctcgacgctagtccgccgctttaatcacggcgcacaaccgcctgtgcagtcggcccttgatggtaaaaccatccctcactggtatcgcatgattaaccgtctgatgtggatctggcgcggcattgacccacgcgaaatcctcgacgtccaggcacgtattgtgatgagcgatgccgaacgtaccgacgatgatttatacgatacggtgattggctaccgtggcggcaactggatttatgagtgggccccggatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagaccccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctagtggtttcatttactctaaacctgtgattcctctgaattattttcattttaaagaaattgtatttgttaaatatgtactacaaacttagtagttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggatcgataagcttgatatcgaattcctgcagccttagtttctaattttcatagtcatataagcctcaatgtagttaataaagatgtcaaactcgctcattgccttatagattcctttttcctgcaacttattgaaagcattcttaacctgctcgacagccttggacttattctcacatgggagaaatctatgacatcttctcaatctaagtctcagcgtcttcaaattctcgccgagggagttcacatgggcttttatgtcggggtcctggttctcagcttgcggcatgacctcttcaagataaaactgaatcatttcgctaagggcttgacatcccaggtagcccttgaagtcctccaaaagagactccttgaggagaagattatccaactggtccttcatctggaagaaggtcttcaccctggaaaatgcatctcgcaagtcgcgaagcatattagggaggttgcccggaaaatgcgtacaggagttttcgctttgtgtcccttgaccgggtgacgcgcgtactccagtcaggagcacgagacagcaaaggagagcagatgagtgcatttctgtgtatgtgtggtggcgaccggtggatccttaagcgggtcgctgcagggtcgctcggtgttcgaggccacacgcgtcaccttaatatgcgaaactagttatccactccgtgtaagggagagtgagcctcttacgaatgcgcgacatcggctacgccgttccgaggcgactgatacgcgcgacatcggctacgccgtacgaaggcagtccgattgcgcgacatcggctacgccgacctttactgagacgggagcgcgacatcggctacgccgaaggcgttgcgaatcctcatgcgattgttacgaaacccgccgataaaataaaagattttatttagtctccagaaaaaggggggaatgaaagaccccacctgtaggtttggcaagctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggggggatctggagctctcgagaattctcacgcgtgccgccaccatgtctagacccggagagcgcccattccagtgtcggatttgcatgcggaacttttcgagaagacacggcctggacagacatacccgtactcatacaggtgaaaaaccctttcagtgtcggatctgtatgcgaaatttctccgaccacagcagcctgaagagacatctacgtacccacaccggcagccagaagccatttcagtgtcggatctgtatgcggaacttctccgtgagacacaacctgaccagacatctacgtacgcacaccggagagaagccattccaatgccgaatatgcatgcgcaacttcagtgaccacagcaacctgagcagacacctaaaaacccacaccggttcccagaagccatttcagtgtcggatctgtatgcggaacttctcccagcgcagcagcctggtgagacatctacgtacgcacaccggagagaagccattccaatgccgaatatgcatgcgcaacttcagtgagagcggccacctgaagagacacctgcgtacgcacctgaggggatccacctgcagggactacaaagaccatgacggtgattataaagatcatgacatcgattacaaggatgacgatgacaagatggcccccaagaaaaagaggaaggtgggcattcacggggtgccgggtggactcgagggaggcggtggaagcggcggtaccgaggacgtggtgtgctgccactcaatctacggcaagaagaagggtgatatcgacacctaccgatacataggctcttccgggacaggctgcgtggtcatagtgggcaggatcgtcttgtccggatccggcactagtgcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctgggcagtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagagacaaccatgagatccccggtgttcacggacaactcctctccaccagcagtcaccctgacgcacccaatcaccaaaatcgatagggaggttctctaccaggagttcgatgagatggaagagtgctctcagcactatccctacgatgtgcccgattacgctggaggcggtggaagcggcggtaccgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcccaattgtaagcggccgcgactctagagtcgacctgcaggcatgcaagcttgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagggaattaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagcatctagaattaattccgtgtattctatagtgtcacctaaatcgtatgtgtatgatacataaggttatgtattaattgtagccgcgttctaacgacaatatgtacaagcctaattgtgtagcatctggcttactgaagcagaccctatcatctctctcgtaaactgccgtcagagtcggtttggttggacgaaccttctgagtttctggtaacgccgtcccgcacccggaaatggtcagcgaaccaatcagcagggtcatcgctagccagatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtctttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataa

SEQ ID NO: 65 - protein, 7 aa, Artificial Sequence
  synthetic polypeptide
PKKKRKV

SEQ ID NO: 66 - protein, 298 aa, Artificial Sequence
  synthetic polypeptide
VPLYGFTSICGRRPEMEAAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLK

SEQ ID NO: 67 - protein, 5 aa, Artificial Sequence
  synthetic polypeptide
GGSGG

SEQ ID NO: 68 - protein, 22 aa, Artificial Sequence
  synthetic polypeptide
GSGATNFSLLKQAGDVEENPGP

SEQ ID NO: 69 - protein, 191 aa, Artificial Sequence
  synthetic polypeptide
DEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 70 - protein, 5 aa, Artificial Sequence
  synthetic polypeptide
GGGSG

SEQ ID NO: 71 - protein, 177 aa, Artificial Sequence
  synthetic polypeptide
TQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMN

SEQ ID NO: 72 - protein, 96 aa, Artificial Sequence
  synthetic polypeptide
DAKSLTAWSRTLVTFKDVFVDFTREEWKLLDTAQQILYRNVMLENYKNLVSLGYQLTKPDVILRLEKGEEPWLVEREIHQETHPDSETAFEIKSSV

SEQ ID NO: 73 - protein, 5 aa, Artificial Sequence
  synthetic polypeptide
CVRGS

SEQ ID NO: 74 - protein, 314 aa, Artificial Sequence
  synthetic polypeptide
SAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 75 - protein, 6 aa, Artificial Sequence
  synthetic polypeptide
GGGGSG

SEQ ID NO: 76 - protein, 176 aa, Artificial Sequence
  synthetic polypeptide
  misc_feature (19)..(25): Xaa can be any naturally occurring amino acid
  misc_feature (47)..(53): Xaa can be any naturally occurring amino acid
  misc_feature (76)..(82): Xaa can be any naturally occurring amino acid
  misc_feature (104)..(110): Xaa can be any naturally occurring amino acid
  misc_feature (133)..(139): Xaa can be any naturally occurring amino acid
  misc_feature (161)..(167): Xaa can be any naturally occurring amino acid
SRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGS

SEQ ID NO: 77 - protein, 39 aa, Artificial Sequence
  synthetic polypeptide
DYKDHDGDYKDHDIDYKDDDDKMAPKKKRKVGIHGVPGG

SEQ ID NO: 78 - protein, 10 aa, Artificial Sequence
  synthetic polypeptide
EDVVCCHSIY

SEQ ID NO: 79 - protein, 8 aa, Artificial Sequence
  synthetic polypeptide
HSIYGKKK

SEQ ID NO: 80 - protein, 6 aa, Artificial Sequence
  synthetic polypeptide
DTYRYI

SEQ ID NO: 81 - protein, 13 aa, Artificial Sequence
  synthetic polypeptide
GCVVIVGRIVLSG

SEQ ID NO: 82 - protein, 189 aa, Artificial Sequence
  synthetic polypeptide
APITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSS

SEQ ID NO: 83 - protein, 14 aa, Artificial Sequence
  synthetic polypeptide
LYQEFDEMEECSQH

SEQ ID NO: 84 - protein, 9 aa, Artificial Sequence
  synthetic polypeptide
YPYDVPDYA

SEQ ID NO: 85 - protein, 241 aa, Artificial Sequence
  synthetic polypeptide
GKKKGDIDTYRYIGSSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDREV

SEQ ID NO: 86 - protein, 304 aa, Artificial Sequence
  synthetic polypeptide
DEMEECSQHLPGAGSSGDIMDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 87 - protein, 10 aa, Artificial Sequence
  synthetic polypeptide
DEMEECSQHL

SEQ ID NO: 88 - protein, 10 aa, Artificial Sequence
  synthetic polypeptide
PGAGSSGDIM

SEQ ID NO: 89 - protein, 8 aa, Artificial Sequence
  synthetic polypeptide
DYKDDDDK

SEQ ID NO: 90 - protein, 12 aa, Artificial Sequence
  synthetic polypeptide
GSSGTGSGSGTS

SEQ ID NO: 91 - protein, 186 aa, Artificial Sequence
  synthetic polypeptide
APITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTD

SEQ ID NO: 92 - protein, 33 aa, Artificial Sequence
  synthetic polypeptide
NSSPPAVTLTHPITKIDTKYIMTCMSADLEVVT

SEQ ID NO: 93 - protein, 45 aa, Artificial Sequence
  synthetic polypeptide
STWVLVGGVLAALAAYCLSTGCVVIVGRIVLSGKPAIIPDREVLY

SEQ ID NO: 94 - protein, 297 aa, Artificial Sequence
  synthetic polypeptide
DYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLYQEFEDVVPCSMGS

SEQ ID NO: 95 - protein, 303 aa, Artificial Sequence
  synthetic polypeptide
DYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAGSSGSSIIPDREVLYQEFEDVVPCSMGS

SEQ ID NO: 96 - protein, 51 aa, Artificial Sequence
  synthetic polypeptide
STWVLVGGVLAALAAYCLSTGCVVIVGRIVLSGKPAGSSGSSIIPDREVLY

SEQ ID NO: 97 - protein, 65 aa, Artificial Sequence
  synthetic polypeptide
LAVSVTFEDVAVLFTRDEWKKLDLSQRSLYREVMLENYSNLASMAGFLFTKPKVISLLQQGEDPW

SEQ ID NO: 98 - protein, 190 aa, Artificial Sequence
  synthetic polypeptide
GKKTKRTADSSSSEDEEEYVVEKVLDRRVVKGQVEYLLKWKGFSEEHNTWEPEKNLDCPELISEFMKKYKKMKEGENNKPREKSESNKRKSNFSNSADDIKSKKKREQSNDIARGFERGLEPEKIIGATDSCGDLMFLMKWKDTDEADLVLAKEANVKCPQIVIAFYEERLTWHAYPEDAENKEKETAKS

SEQ ID NO: 99 - protein, 440 aa, Artificial Sequence
  synthetic polypeptide
SEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 100 - protein, 9 aa, Artificial Sequence
  synthetic polypeptide
GGSGSGSAC

SEQ ID NO: 101 - protein, 172 aa, Artificial Sequence
  synthetic polypeptide
  misc_feature (17)..(23): Xaa can be any naturally occurring amino acid
  misc_feature (45)..(51): Xaa can be any naturally occurring amino acid
  misc_feature (74)..(80): Xaa can be any naturally occurring amino acid
  misc_feature (102)..(108): Xaa can be any naturally occurring amino acid
  misc_feature (131)..(137): Xaa can be any naturally occurring amino acid
  misc_feature (159)..(165): Xaa can be any naturally occurring amino acid
PGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLR

SEQ ID NO: 102 - protein, 265 aa, Artificial Sequence
  synthetic polypeptide
EDVVCCHSIYGKKKGDIDTYRYIGSSGTGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDREVLYQEFDEMEECSQH

SEQ ID NO: 103 - protein, 9 aa, Artificial Sequence
  synthetic polypeptide
LEGGGGSGG

SEQ ID NO: 104 - protein, 8 aa, Artificial Sequence
  synthetic polypeptide
GGGGSGGT

SEQ ID NO: 105 - protein, 15 aa, Artificial Sequence
  synthetic polypeptide
NSSPPAVTLTHPITK

SEQ ID NO: 106 - protein, 63 aa, Artificial Sequence
  synthetic polypeptide
IDTKYIMTCMSADLEVVTSTWVLVGGVLAALAAYCLSTGCVVIVGRIVLSGKPAIIPDREVLY

SEQ ID NO: 107 - protein, 305 aa, Artificial Sequence
  synthetic polypeptide
PLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDK

SEQ ID NO: 108 - protein, 188 aa, Artificial Sequence
  synthetic polypeptide
APTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYA

SEQ ID NO: 109 - protein, 109 aa, Artificial Sequence
  synthetic polypeptide
SRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 110 - protein, 92 aa, Artificial Sequence
  synthetic polypeptide
ILWHEMWHEGLEEASRLYFGERNVKGMFEVLEPLHAMMERGPQTLKETSFNQAYGRDLMEAQEWCRKYMKSGNVKDLLQAWDLYYHVFRRIS

SEQ ID NO: 111 - protein, 92 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLN

SEQ ID NO: 112 - protein, 345 aa, Artificial Sequence
  synthetic polypeptide
MAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 113 - protein, 150 aa, Artificial Sequence
  synthetic polypeptide
HTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETE

SEQ ID NO: 114 - protein, 150 aa, Artificial Sequence
  synthetic polypeptide
HTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETE

SEQ ID NO: 115 - protein, 171 aa, Artificial Sequence
  synthetic polypeptide
MNGAIGGDLLLNFPDMSVLERQRAHLKYLNPTFDSPLAGFFADSSMITGGEMDSYLSTAGLNLPMMYGETTVEGDSRLSISPETTLGTGNFKKRKFDTETKDCNEKKKKMTMNRDDLVEEGEEEKSKITEQNNGSTKSIKKMKHKAKKEENNFSNDSSKVTKELEKTDYIH

SEQ ID NO: 116 - protein, 612 aa, Artificial Sequence
  synthetic polypeptide
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 117 - protein, 551 aa, Artificial Sequence
  synthetic polypeptide
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 118 - protein, 261 aa, Artificial Sequence
  synthetic polypeptide
SQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALL

SEQ ID NO: 119 - protein, 112 aa, Artificial Sequence
  synthetic polypeptide
SLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALL

SEQ ID NO: 120 - protein, 162 aa, Artificial Sequence
  synthetic polypeptide
SVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALL

SEQ ID NO: 121 - protein, 62 aa, Artificial Sequence
  synthetic polypeptide
SPHTTEPMLMEYPEAITRLVTGAQRPPDPAPAPLGAPGLPNGLLSGDEDFSSIADMDFSALL

SEQ ID NO: 122 - protein, 7 aa, Artificial Sequence
  synthetic polypeptide
DEANLRR

SEQ ID NO: 123 - protein, 7 aa, Artificial Sequence
  synthetic polypeptide
DPSVLKR

SEQ ID NO: 124 - protein, 7 aa, Artificial Sequence
  synthetic polypeptide
QSANLLR

SEQ ID NO: 125 - protein, 7 aa, Artificial Sequence
  synthetic polypeptide
DPSSLKR

SEQ ID NO: 126 - protein, 7 aa, Artificial Sequence
  synthetic polypeptide
QQTNLTR

SEQ ID NO: 127 - protein, 7 aa, Artificial Sequence
  synthetic polypeptide
DATQLVR

SEQ ID NO: 128 - protein, 7 aa, Artificial Sequence
  synthetic polypeptide
ERRSLAR

SEQ ID NO: 129 - protein, 7 aa, Artificial Sequence
  synthetic polypeptide
EEANLRR

SEQ ID NO: 130 - protein, 7 aa, Artificial Sequence
  synthetic polypeptide
DHSSLKR

SEQ ID NO: 131 - protein, 7 aa, Artificial Sequence
  synthetic polypeptide
QRSSLVR

SEQ ID NO: 132 - protein, 7 aa, Artificial Sequence
  synthetic polypeptide
DMGNLGR

SEQ ID NO: 133 - protein, 7 aa, Artificial Sequence
  synthetic polypeptide
RSHDLTR

SEQ ID NO: 134 - protein, 7 aa, Artificial Sequence
  synthetic polypeptide
HKSSLTR

SEQ ID NO: 135 - protein, 7 aa, Artificial Sequence
  synthetic polypeptide
DSSNLRR

SEQ ID NO: 136 - protein, 7 aa, Artificial Sequence
  synthetic polypeptide
DQGNLIR

SEQ ID NO: 137 - protein, 7 aa, Artificial Sequence
  synthetic polypeptide
QKQALTR

SEQ ID NO: 138 - protein, 7 aa, Artificial Sequence
  synthetic polypeptide
DRGNLTR

SEQ ID NO: 139 - protein, 7 aa, Artificial Sequence
  synthetic polypeptide
RSHDLTV

SEQ ID NO: 140 - protein, 7 aa, Artificial Sequence
  synthetic polypeptide
DKSVLAR

SEQ ID NO: 141 - protein, 7 aa, Artificial Sequence
  synthetic polypeptide
QTNNLGR

SEQ ID NO: 142 - protein, 7 aa, Artificial Sequence
  synthetic polypeptide
THAVLTR

SEQ ID NO: 143 - protein, 7 aa, Artificial Sequence
  synthetic polypeptide
TKSLLAR

SEQ ID NO: 144 - protein, 7 aa, Artificial Sequence
  synthetic polypeptide
QKQALDR

SEQ ID NO: 145 - protein, 7 aa, Artificial Sequence
  synthetic polypeptide
DTSVLNR

SEQ ID NO: 146 - protein, 7 aa, Artificial Sequence
  synthetic polypeptide
QGTSLAR

SEQ ID NO: 147 - protein, 7 aa, Artificial Sequence
  synthetic polypeptide
VRHNLTR

SEQ ID NO: 148 - protein, 7 aa, Artificial Sequence
  synthetic polypeptide
EKQNLAR

SEQ ID NO: 149 - protein, 7 aa, Artificial Sequence
  synthetic polypeptide
DPSNLRR

SEQ ID NO: 150 - protein, 7 aa, Artificial Sequence
  synthetic polypeptide
DHSNLSR

SEQ ID NO: 151 - protein, 7 aa, Artificial Sequence
  synthetic polypeptide
QSTSLQR

SEQ ID NO: 152 - protein, 7 aa, Artificial Sequence
  synthetic polypeptide
NMSNLTR

SEQ ID NO: 153 - protein, 7 aa, Artificial Sequence
  synthetic polypeptide
DRSVLRR

SEQ ID NO: 154 - protein, 7 aa, Artificial Sequence
  synthetic polypeptide
LQENLTR

SEQ ID NO: 155 - protein, 7 aa, Artificial Sequence
  synthetic polypeptide
DRSSLRR

SEQ ID NO: 156 - protein, 7 aa, Artificial Sequence
  synthetic polypeptide
QSGTLHR

SEQ ID NO: 157 - protein, 7 aa, Artificial Sequence
  synthetic polypeptide
QLANLAR

SEQ ID NO: 158 - protein, 7 aa, Artificial Sequence
  synthetic polypeptide
DQTTLRR

SEQ ID NO: 159 - protein, 7 aa, Artificial Sequence
  synthetic polypeptide
DPSNLAR

SEQ ID NO: 160 - protein, 7 aa, Artificial Sequence
  synthetic polypeptide
QGGNLAL

SEQ ID NO: 161 - protein, 7 aa, Artificial Sequence
  synthetic polypeptide
RADMLRR

SEQ ID NO: 162 - protein, 7 aa, Artificial Sequence
  synthetic polypeptide
QKANLGV

SEQ ID NO: 163 - protein, 7 aa, Artificial Sequence
  synthetic polypeptide
RLDMLAR

SEQ ID NO: 164 - protein, 7 aa, Artificial Sequence
  synthetic polypeptide
QRGNLNM

SEQ ID NO: 165 - protein, 7 aa, Artificial Sequence
  synthetic polypeptide
RPQELRR

SEQ ID NO: 166 - protein, 7 aa, Artificial Sequence
  synthetic polypeptide
RQDNLGR

SEQ ID NO: 167 - protein, 7 aa, Artificial Sequence
  synthetic polypeptide
DGGNLGR

SEQ ID NO: 168 - protein, 7 aa, Artificial Sequence
  synthetic polypeptide
QQGNLQL

SEQ ID NO: 169 - protein, 7 aa, Artificial Sequence
  synthetic polypeptide
RRQELTR

SEQ ID NO: 170 - protein, 7 aa, Artificial Sequence
  synthetic polypeptide
QASNLTR

SEQ ID NO: 171 - protein, 7 aa, Artificial Sequence
  synthetic polypeptide
RAHNLLL

SEQ ID NO: 172 - protein, 7 aa, Artificial Sequence
  synthetic polypeptide
QSTTLKR

SEQ ID NO: 173 - protein, 7 aa, Artificial Sequence
  synthetic polypeptide
QGTTLKR

SEQ ID NO: 174 - protein, 7 aa, Artificial Sequence
  synthetic polypeptide
QRSNLAR

SEQ ID NO: 175 - protein, 7 aa, Artificial Sequence
  synthetic polypeptide
RRHGLDR

SEQ ID NO: 176 - protein, 7 aa, Artificial Sequence
  synthetic polypeptide
ESGHLKR

SEQ ID NO: 177 - protein, 7 aa, Artificial Sequence
  synthetic polypeptide
QLSNLTR

SEQ ID NO: 178 - protein, 7 aa, Artificial Sequence
  synthetic polypeptide
DRSSLKR

SEQ ID NO: 179 - protein, 7 aa, Artificial Sequence
  synthetic polypeptide
VRHSLTR

SEQ ID NO: 180 - protein, 7 aa, Artificial Sequence
  synthetic polypeptide
ESGALRR

SEQ ID NO: 181 - DNA, 20 bp, Artificial Sequence
  synthetic polynucleotide
cgtcgaagtcgaagtcgacc

SEQ ID NO: 182 - DNA, 20 bp, Artificial Sequence
  synthetic polynucleotide
ggacgacgttacggacgtac

SEQ ID NO: 183 - DNA, 20 bp, Artificial Sequence
  synthetic polynucleotide
agacgtcgaagtagccgtag

SEQ ID NO: 184 - DNA, 20 bp, Artificial Sequence
  synthetic polynucleotide
ggacgacgccgatgtagaag

SEQ ID NO: 185 - DNA, 20 bp, Artificial Sequence
  synthetic polynucleotide
tgaagcagtcgacgccgaag

SEQ ID NO: 186 - DNA, 20 bp, Artificial Sequence
  synthetic polynucleotide
ggacgacgcggtctaagaag

SEQ ID NO: 187 - DNA, 20 bp, Artificial Sequence
  synthetic polynucleotide
cgacgaggtcgcataagtag

SEQ ID NO: 188 - DNA, 20 bp, Artificial Sequence
  synthetic polynucleotide
agacgcagtataggtcgaac

SEQ ID NO: 189 - DNA, 20 bp, Artificial Sequence
  synthetic polynucleotide
agacgcagtataggacgacg

SEQ ID NO: 190 - DNA, 20 bp, Artificial Sequence
  synthetic polynucleotide
cggcgtagccgatgtcgcgc

SEQ ID NO: 191 - DNA, 19 bp, Artificial Sequence
  synthetic polynucleotide
ggtcgttgcggtagtcgaa

SEQ ID NO: 192 - protein, 7 aa, Artificial Sequence
  synthetic polypeptide
QRNNLGR

SEQ ID NO: 193 - protein, 200 aa, Artificial Sequence
  synthetic polypeptide
SQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVA

SEQ ID NO: 194 - protein, 150 aa, Artificial Sequence
  synthetic polypeptide
SQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGT

SEQ ID NO: 195 - protein, 100 aa, Artificial Sequence
  synthetic polypeptide
SQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQ

SEQ ID NO: 196 - protein, 101 aa, Artificial Sequence
  synthetic polypeptide
SRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGT

SEQ ID NO: 197 - protein, 119 aa, Artificial Sequence
  synthetic polypeptide
PTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALL

SEQ ID NO: 198 - protein, 190 aa, Artificial Sequence
  synthetic polypeptide
RDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 199 - protein, 116 aa, Artificial Sequence
  synthetic polypeptide
PLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 200 - protein, 66 aa, Artificial Sequence
  synthetic polypeptide
DLSHPPPRGHLDELTTTLESMTEDLNLDSPLTPELNEILDTFLNDECLLHAMHISTGLSIFDTSLF

SEQ ID NO: 201 - protein, 126 aa, Artificial Sequence
  synthetic polypeptide
SSLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHA

SEQ ID NO: 202 - protein, 101 aa, Artificial Sequence
  synthetic polypeptide
PLDPAPAVTPEASHLLEDPDEETSQAVKALREMADTVIPQKEEAAICGQMDLSHPPPRGHLDELTTTLESMTEDLNLDSPLTPELNEILDTFLNDECLLHA

SEQ ID NO: 203 - protein, 76 aa, Artificial Sequence
  synthetic polypeptide
SVKALREMADTVIPQKEEAAICGQMDLSHPPPRGHLDELTTTLESMTEDLNLDSPLTPELNEILDTFLNDECLLHA

SEQ ID NO: 204 - protein, 51 aa, Artificial Sequence
  synthetic polypeptide
DLSHPPPRGHLDELTTTLESMTEDLNLDSPLTPELNEILDTFLNDECLLHA

SEQ ID NO: 205 - protein, 316 aa, Artificial Sequence
  synthetic polypeptide
GRADALDDFDLDMLGSDALDDFDLDMLGSDALDDFDLDMLGSDALDDFDLDMLINSRSSGSPKKKRKVGSGGGSGGSGSVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSGGGSGGSGSDLSHPPPRGHLDELTTTLESMTEDLNLDSPLTPELNEILDTFLNDECLLHAMHISTGLSIFDTSLF

SEQ ID NO: 206 - protein, 526 aa, Artificial Sequence
  synthetic polypeptide
GRADALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 207 - protein, 11 aa, Artificial Sequence
  synthetic polypeptide
DALDDFDLDML

SEQ ID NO: 208 - protein, 53 aa, Artificial Sequence
  synthetic polypeptide
GRADALDDFDLDMLGSDALDDFDLDMLGSDALDDFDLDMLGSDALDDFDLDML

SEQ ID NO: 209 - protein, 2414 aa, Artificial Sequence
  synthetic polypeptide
MAENVVEPGPPSAKRPKLSSPALSASASDGTDFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGMNAGMNPGMLAAGNGQGIMPNQVMNGSIGAGRGRQNMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQPILTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQVQPSLPAAPSADQPQQQPRSQQSTAASVPTPTAPLLPPQPATPLSQPAVSIEGQVSNPPSTSSTEVNSQAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 210 - protein, 617 aa, Artificial Sequence
  synthetic polypeptide
IFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQD

SEQ ID NO: 211 - protein, 308 aa, Artificial Sequence
  synthetic polypeptide
VNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPI

SEQ ID NO: 212 - protein, 314 aa, Artificial Sequence
  synthetic polypeptide
VNNFLKKKEAGAGEVHIRVVSSSDKCVEVKPGMRRRFVEQGEMMNEFPYRAKALFAFEEVDGIDVCFFGMHVQEYGSECPAPNTRRVYIAYLDSVHFFRPRQYRTAVYHEILLGYMDYVKQLGYTMAHIWACPPSEGDDYIFHCHPTDQKIPKPKRLQEWYKKMLDKGMIERIIQDYKDILKQAMEDKLGSAAELPYFEGDFWPNVLEESIKELDQEEEEKRKQAEAAEAAAAANLFSIEENEVSGDGKKKGQKKAKKSNKSKAAQRKNSKKSNEHQSGNDLSTKIYATMEKHKEVFFVIRLHSAQSAASLAPI

SEQ ID NO: 213 - protein, 634 aa, Artificial Sequence
  synthetic polypeptide
NGKYSDPWEYVDDVWLMFDNAWLYNRKTSRVYRYCTKLSEVFEAEIDPVMQALGYCCGRKYTFNPQVLCCYGKQLCTIPRDAKYYSYQNRYTYCQKCFNDIQGDTVTLGDDPLQSQTQIKKDQFKEMKNDHLELEPFVNCQECGRKQHQICVLWLDSIWPGGFVCDNCLKKKNSKRKENKFNAKRLPTTKLGVYIETRVNNFLKKKEAGAGEVHIRVVSSSDKCVEVKPGMRRRFVEQGEMMNEFPYRAKALFAFEEVDGIDVCFFGMHVQEYGSECPAPNTRRVYIAYLDSVHFFRPRQYRTAVYHEILLGYMDYVKQLGYTMAHIWACPPSEGDDYIFHCHPTDQKIPKPKRLQEWYKKMLDKGMIERIIQDYKDILKQAMEDKLGSAAELPYFEGDFWPNVLEESIKELDQEEEEKRKQAEAAEAAAAANLFSIEENEVSGDGKKKGQKKAKKSNKSKAAQRKNSKKSNEHQSGNDLSTKIYATMEKHKEVFFVIRLHSAQSAASLAPIQDPDPLLTCDLMDGRDAFLTLARDKHFEFSSLRRAQFSTLSMLYELHNQGQDKFVYTCNHCKTAVETRYHCTVCDDFDLCIVCKEKVGHQHKMEKLGFDIDDGSALADHKQANPQEARKQSI

SEQ ID NO: 214 - protein, 382 aa, Artificial Sequence
  synthetic polypeptide
MDAKSLTAWSRTLVTFKDVFVDFTREEWKLLDTAQQIVYRNVMLENYKNLVSLGYQLTKPDVILRLEKGEEPWLVSGGGSGGSGSSPKKKRKVEASVQVKRVLEKSPGKLLVKMPFQASPGGKGEGGGATTSAQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHAESPKAPMPLLPPPPPPEPQSSEDPISPPEPQDLSSSICKEEKMPRAGSLESDGCPKEPAKTQPMVAAAATTTTTTTTTVAEKYKHRGEGERKDIVSSSMPRPNREEPVDSRTPVTERVS

SEQ ID NO: 215 - protein, 74 aa, Artificial Sequence
  synthetic polypeptide
DAKSLTAWSRTLVTFKDVFVDFTREEWKLLDTAQQIVYRNVMLENYKNLVSLGYQLTKPDVILRLEKGEEPWLV

SEQ ID NO: 216 - protein, 296 aa, Artificial Sequence
  synthetic polypeptide
PKKKRKVEASVQVKRVLEKSPGKLLVKMPFQASPGGKGEGGGATTSAQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHAESPKAPMPLLPPPPPPEPQSSEDPISPPEPQDLSSSICKEEKMPRAGSLESDGCPKEPAKTQPMVAAAATTTTTTTTTVAEKYKHRGEGERKDIVSSSMPRPNREEPVDSRTPVTERVS

SEQ ID NO: 217 - protein, 792 aa, Artificial Sequence
  synthetic polypeptide
MKGDTRHLNGEEDAGGREDSILVNGACSDQSSDSPPILEAIRTPEIRGRRSSSRLSKREVSSLLSYTQDLTGDGDGEDGDGSDTPVMPKLFRETRTRSESPAVRTRNNNSVSSRERHRPSPRSTRGRQGRNHVDESPVEFPATRSLRRRATASAGTPWPSPPSSYLTIDLTDDTEDTHGTPQSSSTPYARLAQDSQQGGMESPQVEADSGDGDSSEYQDGKEFGIGDLVWGKIKGFSWWPAMVVSWKATSKRQAMSGMRWVQWFGDGKFSEVSADKLVALGLFSQHFNLATFNKLVSYRKAMYHALEKARVRAGKTFPSSPGDSLEDQLKPMLEWAHGGFKPTGIEGLKPNNTQPENKTRRRTADDSATSDYCPAPKRLKTNCYNNGKDRGDEDQSREQMASDVANNKSSLEDGCLSCGRKNPVSFHPLFEGGLCQTCRDRFLELFYMYDDDGYQSYCTVCCEGRELLLCSNTSCCRCFCVECLEVLVGTGTAAEAKLQEPWSCYMCLPQRCHGVLRRRKDWNVRLQAFFTSDTGLEYEAPKLYPAIPAARRRPIRVLSLFDGIATGYLVLKELGIKVGKYVASEVCEESIAVGTVKHEGNIKYVNDVRNITKKNIEEWGPFDLVIGGSPCNDLSNVNPARKGLYEGTGRLFFEFYHLLNYSRPKEGDDRPFFWMFENVVAMKVGDKRDISRFLECNPVMIDAIKVSAAHRARYFWGNLPGMNRPVIASKNDKLELQDCLEYNRIAKDLWLSCALHRRVQHGPWCPPEAAGKVLERACHPTPLRPSEGLLCM

SEQ ID NO: 218 - protein, 1084 aa, Artificial Sequence
  synthetic polypeptide
MSSQSHPDGLSGRDQPVELLNPARVNHMPSTVDVATALPLQVAPSAVPMDLRLDHQFSLPVAEPALREQQLQQELLALKQKQQIQRQILIAEFQRQHEQLSRQHEAQLHEHIKQQQEMLAMKHQQELLEHQRKLERHRQEQELEKQHREQKLQQLKNKEKGKESAVASTEVKMKLQEFVLNKKKALAHRNLNHCISSDPRYWYGKTQHSSLDQSSPPQSGVSTSYNHPVLGMYDAKDDFPLRKTASEPNLKLRSRLKQKVAERRSSPLLRRKDGPVVTALKKRPLDVTDSACSSAPGSGPSSPNNSSGSVSAENGIAPAVPSIPAETSLAHRLVAREGSAAPLPLYTSPSLPNITLGLPATGPSAGTAGQQDTERLTLPALQQRLSLFPGTHLTPYLSTSPLERDGGAAHSPLLQHMVLLEQPPAQAPLVTGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVDSDTIWNEVHSAGAARLAVGCVVELVFKVATGELKNGFAVVRPPGHHAEESTPMGFCYFNSVAVAAKLLQQRLSVSKILIVDWDVHHGNGTQQAFYSDPSVLYMSLHRYDDGNFFPGSGAPDEVGTGPGVGFNVNMAFTGGLDPPMGDAEYLAAFRTVVMPIASEFAPDVVLVSSGFDAVEGHPTPLGGYNLSARCFGYLTKQLMGLAGGRIVLALEGGHDLTAICDASEACVSALLGNELDPLPEKVLQQRPNANAVRSMEKVMEIHSKYWRCLQRTTSTAGRSLIEAQTCENEEAETVTAMASLSVGVKPAEKRPDEEPMEEEPPL

SEQ ID NO: 219 - protein, 31 aa, Artificial Sequence
  synthetic polypeptide
  misc_feature (1)..(3): Xaa can be any naturally occurring amino acid
  misc_feature (5)..(9): Xaa can be any naturally occurring amino acid
  misc_feature (11)..(23): Xaa can be any naturally occurring amino acid
  misc_feature (25)..(30): Xaa can be any naturally occurring amino acid
XXXCXXXXXCXXXXXXXXXXXXXHXXXXXXH

SEQ ID NO: 220 - protein, 23 aa, Artificial Sequence
  synthetic polypeptide
  misc_feature (1)..(3): Xaa can be any naturally occurring amino acid
  misc_feature (5)..(6): Xaa can be any naturally occurring amino acid
  misc_feature (8)..(18): Xaa can be any naturally occurring amino acid
  misc_feature (20)..(22): Xaa can be any naturally occurring amino acid
XXXCXXCXXXXXXXXXXXHXXXH

SEQ ID NO: 221 - protein, 85 aa, Artificial Sequence
  synthetic polypeptide
  misc_feature (16)..(22): Xaa can be any naturally occurring amino acid
  misc_feature (44)..(50): Xaa can be any naturally occurring amino acid
  misc_feature (72)..(78): Xaa can be any naturally occurring amino acid
GERPFQCRICMANFSXXXXXXXHTRTHTGEKPFQCRICMANFSXXXXXXXHLRTHTGEKPFQCRICMANFSXXXXXXXHLKTHLR

SEQ ID NO: 222 - protein, 85 aa, Artificial Sequence
  synthetic polypeptide
  misc_feature (16)..(22): Xaa can be any naturally occurring amino acid
  misc_feature (44)..(50): Xaa can be any naturally occurring amino acid
  misc_feature (72)..(78): Xaa can be any naturally occurring amino acid
GEAPFQCRICMANFSXXXXXXXHTRTHTGEKPFQCRICMANFSXXXXXXXHLRTHTGEKPFQCRICMANFSXXXXXXXHLKTHLR

SEQ ID NO: 223 - protein, 85 aa, Artificial Sequence
  synthetic polypeptide
GERPFQCRICMANFSGRQALDRHTRTHTGEKPFQCRICMANFSDKANLTRHLRTHTGEKPFQCRICMANFSQRNNLGRHLKTHLR

SEQ ID NO: 224 - protein, 85 aa, Artificial Sequence
  synthetic polypeptide
GEAPFQCRICMANFSRQDRLDRHTRTHTGEKPFQCRICMANFSQKEHLAGHLRTHTGEKPFQCRICMANFSRRDNLNRHLKTHLR

SEQ ID NO: 225 - protein, 85 aa, Artificial Sequence
  synthetic polypeptide
GERPFQCRICMANFSRQDRLDRHTRTHTGEKPFQCRICMANFSQKEHLAGHLRTHTGEKPFQCRICMANFSRRDNLNRHLKTHLR

SEQ ID NO: 226 - protein, 85 aa, Artificial Sequence
  synthetic polypeptide
GEAPFQCRICMANFSTGQILDRHTRTHTGEKPFQCRICMANFSVAHSLKRHLRTHTGEKPFQCRICMANFSDPSNLRRHLKTHLR

SEQ ID NO: 227 - protein, 85 aa, Artificial Sequence
  synthetic polypeptide
GERPFQCRICMANFSTGQILDRHTRTHTGEKPFQCRICMANFSVAHSLKRHLRTHTGEKPFQCRICMANFSDPSNLRRHLKTHLR

SEQ ID NO: 228 - protein, 85 aa, Artificial Sequence
  synthetic polypeptide
GERPFQCRICMRNFSRQSNLSRHTRTHTGEKPFQCRICMRNFSRNEHLVLHLRTHTGEKPFQCRICMRNFSQKTGLRVHLKTHLR

SEQ ID NO: 229 - DNA, 11 bp, Artificial Sequence
  synthetic polynucleotide
cgaagacgctg

SEQ ID NO: 230 - DNA, 11 bp, Artificial Sequence
  synthetic polynucleotide
agagtgaggac

SEQ ID NO: 231 - DNA, 11 bp, Artificial Sequence
  synthetic polynucleotide
acagtgaggac

SEQ ID NO: 232 - DNA, 11 bp, Artificial Sequence
  synthetic polynucleotide
atagtgaggac

SEQ ID NO: 233 - DNA, 11 bp, Artificial Sequence
  synthetic polynucleotide
agacgctgctc

SEQ ID NO: 234 - DNA, 11 bp, Artificial Sequence
  synthetic polynucleotide
tgacgctgctt

SEQ ID NO: 235 - DNA, 11 bp, Artificial Sequence
  synthetic polynucleotide
agacggtgctc

SEQ ID NO: 236 - DNA, 11 bp, Artificial Sequence
  synthetic polynucleotide
acacgctgctc

SEQ ID NO: 237 - DNA, 11 bp, Artificial Sequence
  synthetic polynucleotide
agacgctactc

SEQ ID NO: 238 - DNA, 11 bp, Artificial Sequence
  synthetic polynucleotide
agacgctgcta

SEQ ID NO: 239 - DNA, 11 bp, Artificial Sequence
  synthetic polynucleotide
agactctgctc

SEQ ID NO: 240 - DNA, 11 bp, Artificial Sequence
  synthetic polynucleotide
attatgggaga

SEQ ID NO: 241 - protein, 180 aa, Artificial Sequence
  synthetic polypeptide
APITAYAQQTRGLLGCIITSLTGRDKNQVEGEVQIVSTATQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMR

SEQ ID NO: 242 - protein, 180 aa, Artificial Sequence
  synthetic polypeptide
APITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMR

SEQ ID NO: 243 - protein, 180 aa, Artificial Sequence
  synthetic polypeptide
APITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTR

SEQ ID NO: 244 - protein, 180 aa, Artificial Sequence
  synthetic polypeptide
APITAYAQQTRGLLGTIVTSLTGRDKNVVTGEVQVLSTATQTFLGTTVGGVIWTVYHGAGSRTLAGAKHPALQMYTNVDQDLVGWPAPPGAKSLEPCACGSSDLYLVTRDADVIPARRRGDSTASLLSPRPLACLKGSSGGPVMCPSGHVAGIFRAAVCTRGVAKSLQFIPVETLSTQAR

SEQ ID NO: 245 - protein, 180 aa, Artificial Sequence
  synthetic polypeptide
APITAYAQQTRGLFSTIVTSLTGRDTNENCGEVQVLSTATQSFLGTAVNGVMWTVYHGAGAKTISGPKGPVNQMYTNVDQDLVGWPAPPGVRSLAPCTCGSADLYLVTRHADVIPVRRRGDTRGALLSPRPISILKGSSGGPLLCPMGHRAGIFRAAVCTRGVAKAVDFVPVESLETTMR

SEQ ID NO: 246 - protein, 180 aa, Artificial Sequence
  synthetic polypeptide
APITAYAQQTRGVLGAIVLSLTGRDKNEAEGEVQFLSTATQTFLGICINGVMWTLFHGAGSKTLAGPKGPVVQMYTNVDKDLVGWPSPPGKGSLTRCTCGSADLYLVTRHADVIPARRRGDTRASLLSPRPISYLKGSSGGPIMCPSGHVVGVFRAAVCTRGVAKALEFVPVENLETTMR

SEQ ID NO: 247 - protein, 180 aa, Artificial Sequence
  synthetic polypeptide
APITAYAQQTRGLVGTIVTSLTGRDKNEAEGEVQVVSTATQSFLATTINGVLWTVYHGAGSKNLAGPKGPVCQMYTNVDQDLVGWPAPLGARSLAPCTCGSSDLYLVTRGADVIPARRRGDTRAALLSPRPISTLKGSSGGPLMCPSGHVVGLFRAAVCTRGVAKALDFIPVENMDTTMR

SEQ ID NO: 248 - protein, 180 aa, Artificial Sequence
  synthetic polypeptide
APISAYAQQTRGLISTLVVSLTGRDKNETAGEVQVLSTSTQTFLGTNVGGVMWGPYHGAGTRTVAGRGGPVLQMYTSVSDDLVGWPAPPGSKSLEPCSCGSADLYLVTRNADVLPLRRKGDGTASLLSPRPVSSLKGSSGGPVLCPQSHCVGIFRAAVCTRGVAKAVQFVPIEKMQVAQR

SEQ ID NO: 249 - protein, 180 aa, Artificial Sequence
  synthetic polypeptide
APITAYAQQTRGLLGCIITSLTGRDKNQVEGEVQIVSTATQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVTKAVDFIPVENLETTMR

SEQ ID NO: 250 - protein, 180 aa, Artificial Sequence
  synthetic polypeptide
APITAYSQQTRGLLGCIITSLTGRDKNQVEGEVQVVSTATQSFLATCVNGVCWTVYHGAGSKTLAAPKGPITQMYTNVDQDLVGWPKPPGARSLTPCTCGSSDLYLVTRHADVIPVRRRGDSRGSLLSPRPVSYLKGSSGGPLLCPFGHAVGIFRAAVCTRGVAKAVDFVPVESMETTMR

SEQ ID NO: 251 - protein, 180 aa, Artificial Sequence
  synthetic polypeptide
APITAYAQQTRGLLGTIVVSMTGRDKTEQAGEIQVLSTVTQSFLGTTISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTR

SEQ ID NO: 252 - protein, 182 aa, Artificial Sequence
  synthetic polypeptide
APITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVSYNTFGVAKSIDFIPVESLDVATR

SEQ ID NO: 253 - protein, 180 aa, Artificial Sequence; identical to SEQ ID NO: 244
  synthetic polypeptide

SEQ ID NO: 254 - protein, 186 aa, Artificial Sequence
  synthetic polypeptide
APITAYAQQTRGLLGCIITSLTGRDKNQVEGEVQIMSTATQTFLATCINGVCWAVYHGAGTRTIASPKGPVIQMYTNVDQDLVGWPAPQGSRSLTPCTCGSSDLYLVTRHADVIPVRRRGDGRGSLLSPRPISYLKGSSGGPLLCPAGHAVGLFRAAVCTRGVAKAVDFIPVENLETTMRSPVFTD

SEQ ID NO: 255 - protein, 186 aa, Artificial Sequence
  synthetic polypeptide
APITAYAQQTRGLLGCIITSLTGRDKNQVEGEVQIVSTATQTLLATCINGVCWAVYHGAGTRTIASPKGPVIQMYTNVDKDLVGWPAPQGSRSLTPCTCGSSDLYLVTRHADVIPVRRRGDRRGSLLSPRPISYLKGSSGGPLLCPAGHAVGLFRAAVCTRGVAKAVYFIPVENLETTMRSPVFTD

SEQ ID NO: 256 - protein, 12 aa, Artificial Sequence
  synthetic polypeptide
GSVVIVGRIILS

SEQ ID NO: 257 - protein, 14 aa, Artificial Sequence
  synthetic polypeptide
GCVVIVGRIVLSGK

SEQ ID NO: 258 - protein, 14 aa, Artificial Sequence
  synthetic polypeptide
GCVCIIGRLHINQR

SEQ ID NO: 259 - protein, 14 aa, Artificial Sequence
  synthetic polypeptide
GCVVIVGHIELEGK

SEQ ID NO: 260 - protein, 14 aa, Artificial Sequence
  synthetic polypeptide
GSVVIVGRVVLSGQ

SEQ ID NO: 261 - protein, 14 aa, Artificial Sequence
  synthetic polypeptide
GSVAIVGRIILSGR

SEQ ID NO: 262 - protein, 14 aa, Artificial Sequence
  synthetic polypeptide
GCVVICGRIVTSGK

SEQ ID NO: 263 - protein, 14 aa, Artificial Sequence
  synthetic polypeptide
GSVVVVGRVVLGSN

SEQ ID NO: 264 - protein, 54 aa, Artificial Sequence
  synthetic polypeptide
STWVLVGGVLAALAAYCLSTGCVVIVGRIVLSGKPAIIPDREVLYQEFDEMEEC

SEQ ID NO: 265 - protein, 54 aa, Artificial Sequence
  synthetic polypeptide
STWVLVGGVLAALAAYCLSTGCVVIVGRVVLSGKPAIIPDREVLYREFDEMEEC

SEQ ID NO: 266 - protein, 54 aa, Artificial Sequence
  synthetic polypeptide
STWVLVGGVLAALAAYCLSTGCVVIVGRIVLSGRPAIIPDREVLYREFDEMEEC

SEQ ID NO: 267 - protein, 54 aa, Artificial Sequence
  synthetic polypeptide
STWVLVGGVLAALAAYCLTTGSVVIVGRIILSGRPAIVPDRELLYQEFDEMEEC

SEQ ID NO: 268 - protein, 54 aa, Artificial Sequence
  synthetic polypeptide
STWVLVGGVLAALAAYCLTTGSVVIVGRIILSGRPAIIPDRELLYQEFDEMEEC

SEQ ID NO: 269 - protein, 54 aa, Artificial Sequence
  synthetic polypeptide
STWVLVGGVLAALAAYCLTTGSVVIVGRIILSGKPAVVPDRELLYQEFDEMEEC

SEQ ID NO: 270 - protein, 54 aa, Artificial Sequence
  synthetic polypeptide
STWVLVGGVLAALAAYCLTTGSVVIVGRIILSGRPAVIPDRELLYREFDEMEEC

SEQ ID NO: 271 - protein, 54 aa, Artificial Sequence
  synthetic polypeptide
STWVLAGGVLAAVAAYCLATGCVCIIGRLHVNQRAVVAPDKEVLYEAFDEMEEC

SEQ ID NO: 272 - protein, 54 aa, Artificial Sequence
  synthetic polypeptide
STWVLAGGVLAAVAAYCLATGCVSIIGRLHINGRAVVAPDKEVLYEAFDEMEEC

SEQ ID NO: 273 - protein, 54 aa, Artificial Sequence
  synthetic polypeptide
SSWVLAGGVLAAVAAYCLATGCISIIGRLHLNDRVVVAPDKEILYEAFDEMEEC

SEQ ID NO: 274 - protein, 54 aa, Artificial Sequence
  synthetic polypeptide
STWVLAGGVLAAVAAYCLATGCVSIIGRLHLNDQVVVTPDKEILYEAFDEMEEC

SEQ ID NO: 275 - protein, 54 aa, Artificial Sequence
  synthetic polypeptide
STWVLLGGVLAALAAYCLSVGCVVIVGHIELEGKPALVPDKEVLYQQYDEMEEC

SEQ ID NO: 276 - protein, 54 aa, Artificial Sequence
  synthetic polypeptide
STWVLLGGVLAAVAAYCLSVGCVVIVGHIELGGKPALVPDKEVLYQQYDEMEEC

SEQ ID NO: 277 - protein, 4 aa, Artificial Sequence
  synthetic polypeptide
SGTS

SEQ ID NO: 278 - protein, 4 aa, Artificial Sequence
  synthetic polypeptide
GSGS

SEQ ID NO: 279 - protein, 13 aa, Artificial Sequence
  synthetic polypeptide
QEFEDVVPCSMGS

SEQ ID NO: 280 - protein, 9 aa, Artificial Sequence
  synthetic polypeptide
EDVVCCHSI

SEQ ID NO: 281 - protein, 9 aa, Artificial Sequence
  synthetic polypeptide
DEMEECSQH

SEQ ID NO: 282 - protein, 20 aa, Artificial Sequence
  synthetic polypeptide
CMSADLEVVTSTWVLVGGVL

SEQ ID NO: 283 - protein, 20 aa, Artificial Sequence
  synthetic polypeptide
CMSADLEVVTSTWVLVGGVL

SEQ ID NO: 284 - protein, 20 aa, Artificial Sequence
  synthetic polypeptide
CMQADLEVMTSTWVLAGGVL

SEQ ID NO: 285 - protein, 20 aa, Artificial Sequence
  synthetic polypeptide
CMQADLEIMTSSWVLAGGVL

SEQ ID NO: 286 - protein, 20 aa, Artificial Sequence
  synthetic polypeptide
CMSADLEVTTSTWVLLGGVL

SEQ ID NO: 287 - protein, 20 aa, Artificial Sequence
  synthetic polypeptide
YQEFDEMEECSQHLPYIEQG

SEQ ID NO: 288 - protein, 20 aa, Artificial Sequence
  synthetic polypeptide
YQEFDEMEECASHLPYIEQG

SEQ ID NO: 289 - protein, 20 aa, Artificial Sequence
  synthetic polypeptide
YEAFDEMEECASRAALIEEG

SEQ ID NO: 290 - protein, 20 aa, Artificial Sequence
  synthetic polypeptide
YEAFDEMEECASKAALIEEG

SEQ ID NO: 291 - protein, 20 aa, Artificial Sequence
  synthetic polypeptide
YQQYDEMEECSQAAPYIEQA

SEQ ID NO: 292 - protein, 20 aa, Artificial Sequence
  synthetic polypeptide
WISSECTTPCSGSWLRDVWD

SEQ ID NO: 293 - protein, 20 aa, Artificial Sequence
  synthetic polypeptide
WINEDCSTPCSGSWLRDVWD

SEQ ID NO: 294 - protein, 20 aa, Artificial Sequence
  synthetic polypeptide
WITEDCPIPCSGSWLRDVWD

SEQ ID NO: 295 - protein, 20 aa, Artificial Sequence
  synthetic polypeptide
WITEDCPVPCSGSWLQDIWD

SEQ ID NO: 296 - protein, 20 aa, Artificial Sequence
  synthetic polypeptide
WINEDYPSPCSDDWLRTIWD

SEQ ID NO: 297 - protein, 20 aa, Artificial Sequence
  synthetic polypeptide
GADTEDVVCCSMSYSWTGAL

SEQ ID NO: 298 - protein, 20 aa, Artificial Sequence
  synthetic polypeptide
EEASEDVVCCSMSYTWTGAL

SEQ ID NO: 299 - protein, 20 aa, Artificial Sequence
  synthetic polypeptide
SEEDDSVVCCSMSYSWTGAL

SEQ ID NO: 300 - protein, 20 aa, Artificial Sequence
  synthetic polypeptide
SDQEDSVICCSMSYSWTGAL

SEQ ID NO: 301 - protein, 20 aa, Artificial Sequence
  synthetic polypeptide
DSEEQSVVCCSMSYSWTGAL

SEQ ID NO: 302 - protein, 11 aa, Artificial Sequence
  synthetic polypeptide
NSSPPAVTLTH

SEQ ID NO: 303 - protein, 5 aa, Artificial Sequence
  synthetic polypeptide
GGSGG

SEQ ID NO: 304 - protein, 221 aa, Artificial Sequence
  synthetic polypeptide
TGCVVIVGRIVLSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHGGSGGS

SEQ ID NO: 305 - protein, 221 aa, Artificial Sequence
  synthetic polypeptide
TGCVVIVGRIVLSGSGTSAPITAYAQQTRGLLGCIITSLTGRDKNQVEGEVQIMSTATQTFLATCINGVCWAVYHGAGTRTIASPKGPVIQMYTNVDQDLVGWPAPQGSRSLTPCTCGSSDLYLVTRHADVIPVRRRGDGRGSLLSPRPISYLKGSSGGPLLCPAGHAVGLFRAAVCTRGVAKAVDFIPVENLETTMRSPVFTDNSSPPAVTLTHGGSGGS

SEQ ID NO: 306 - protein, 221 aa, Artificial Sequence
  synthetic polypeptide
TGCVVIVGRIVLSGSGTSAPITAYAQQTRGLLGCIITSLTGRDKNQVEGEVQIVSTATQTLLATCINGVCWAVYHGAGTRTIASPKGPVIQMYTNVDKDLVGWPAPQGSRSLTPCTCGSSDLYLVTRHADVIPVRRRGDRRGSLLSPRPISYLKGSSGGPLLCPAGHAVGLFRAAVCTRGVAKAVYFIPVENLETTMRSPVFTDNSSPPAVTLTHGGSGGS

SEQ ID NO: 307 - protein, 182 aa, Artificial Sequence
  synthetic polypeptide
MAPITAYAQQTRGLLGCIITSLTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRS

SEQ ID NO: 308 - protein, 195 aa, Artificial Sequence
  synthetic polypeptide
MKKKGSVVIVGRIVLNGAYAQQTRGLLGCIITSLTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 309 - protein, 195 aa, Artificial Sequence
  synthetic polypeptide
MKKKGSVVIVGRIVLNGAYAQQTRGEEGCQETSQTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 310 - protein, 197 aa, Artificial Sequence
  synthetic polypeptide
MKKKGSVVIVGRINLSGDTAYAQQTRGEEGCQETSQTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 311 - protein, 197 aa, Artificial Sequence
  synthetic polypeptide
MKKKGSVVIVGRINLSGDTAYAQQTRGEEGCQETSQTGRDKNQVEGEVQIVSTATQTFLATCINGVCWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 312 - protein, 197 aa, Artificial Sequence
  synthetic polypeptide
MKKKGSVVIVGRINLSGDTAYAQQTRGEEGCQETSQTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVSTRGVAKAVDFIPVESLETTMRSP

SEQ ID NO: 313 - protein, 197 aa, Artificial Sequence
  synthetic polypeptide
MKKKGSVVIVGRINLSGDTAYAQQTRGEQGCQKTSHTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVSTRGVAKAVDFIPVESLETTMRSP

SEQ ID NO: 314 - protein, 197 aa, Artificial Sequence
  synthetic polypeptide
MKKKGSVVIVGRINLSGDTAYAQQTRGEQGTQKTSHTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVSTRGVAKAVDFIPVESLETTMRSP

SEQ ID NO: 315 - protein, 196 aa, Artificial Sequence
  synthetic polypeptide
KKKGSVVIVGRINLSGDTAYAQQTRGEEGCQETSQTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSAGGPLLCPAGHAVGIFRAAVSTRGVAKAVDFIPVESLETTMRSP

SEQ ID NO: 316 - protein, 21 aa, Artificial Sequence
  synthetic polypeptide
GELDELVYLLDGPGYDPIHSD

SEQ ID NO: 317 - protein, 158 aa, Artificial Sequence
  synthetic polypeptide
ISLIAALAVDYVIGMENAMPWNLPADLAWFKRNTLNKPVIMGRHTWESIGRPLPGRKNIILSSQPSTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 318 - protein, 107 aa, Artificial Sequence
  synthetic polypeptide
GVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 319 - protein, 19 aa, Artificial Sequence
  synthetic polypeptide
TRGVEEVAEGVVLLRRRGN

SEQ ID NO: 320 - protein, 229 aa, Artificial Sequence
  synthetic polypeptide
MMGSVELNLRETELCLGLPGGDTVAPVTGNKRGFSETVDLKLNLNNEPANKEGSTTHDVVTFDSKEKSACPKDPAKPPAKAQVVGWPPVRSYRKNVMVSCQKSSGGPEAAAFVKVSMDGAPYLRKIDLRMYKSYDELSNALSNMFSSFTMGKHGGEEGMIDFMNERKLMDLVNSWDYVPSYEDKDGDWMLVGDVPWPMFVDTCKRLRLMKGSDAIGLAPRAMEKCKSRA

SEQ ID NO: 321 - protein, 68 aa, Artificial Sequence
  synthetic polypeptide
KEKSACPKDPAKPPAKAQVVGWPPVRSYRKNVMVSCQKSSGGPEAAAFVKVSMDGAPYLRKIDLRMYK

SEQ ID NO: 322 - protein, 42 aa, Artificial Sequence
  synthetic polypeptide
PITKIDTKYIMTCMSADLEVVTSTWVLVGGVLAALAAYCLST

SEQ ID NO: 323 - protein, 6 aa, Artificial Sequence
  synthetic polypeptide
GSSGSS

SEQ ID NO: 324 - protein, 304 aa, Artificial Sequence
  synthetic polypeptide
DEMEECSQHLPGAGSSGDIMDYKDDDDKGSSGTGSGSGTSAPITAYAQQTRGLLGCIITSLTGRDKNQVEGEVQIMSTATQTFLATCINGVCWAVYHGAGTRTIASPKGPVIQMYTNVDQDLVGWPAPQGSRSLTPCTCGSSDLYLVTRHADVIPVRRRGDGRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 325 - protein, 297 aa, Artificial Sequence
  synthetic polypeptide
DYKDDDDKGSSGTGSGSGTSAPITAYAQQTRGLLGCIITSLTGRDKNQVEGEVQIMSTATQTFLATCINGVCWAVYHGAGTRTIASPKGPVIQMYTNVDQDLVGWPAPQGSRSLTPCTCGSSDLYLVTRHADVIPVRRRGDGRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLYQEFEDVVPCSMGS

SEQ ID NO: 326 - protein, 303 aa, Artificial Sequence
  synthetic polypeptide
DYKDDDDKGSSGTGSGSGTSAPITAYAQQTRGLLGCIITSLTGRDKNQVEGEVQIMSTATQTFLATCINGVCWAVYHGAGTRTIASPKGPVIQMYTNVDQDLVGWPAPQGSRSLTPCTCGSSDLYLVTRHADVIPVRRRGDGRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAGSSGSSIIPDREVLYQEFEDVVPCSMGS

SEQ ID NO: 327 - protein, 304 aa, Artificial Sequence
  synthetic polypeptide
DEMEECSQHLPGAGSSGDIMDYKDDDDKGSSGTGSGSGTSAPITAYAQQTRGLLGCIITSLTGRDKNQVEGEVQIVSTATQTLLATCINGVCWAVYHGAGTRTIASPKGPVIQMYTNVDKDLVGWPAPQGSRSLTPCTCGSSDLYLVTRHADVIPVRRRGDRRGSLLSPRPISYLKGSSGGPLLCPAGHAVGLFRAAVCTRGVAKAVYFIPVENLETTMRSPVFTDNSSPPAVTLTHPITKIDTKYIMTCMSADLEVVTSTWVLVGGVLAALAAYCLSTGCVVIVGRIVLSGKPAIIPDREVLY

SEQ ID NO: 328 - protein, 297 aa, Artificial Sequence
  synthetic polypeptide
DYKDDDDKGSSGTGSGSGTSAPITAYAQQTRGLLGCIITSLTGRDKNQVEGEVQIVSTATQTLLATCINGVCWAVYHGAGTRTIASPKGPVIQMYTNVDKDLVGWPAPQGSRSLTPCTCGSSDLYLVTRHADVIPVRRRGDRRGSLLSPRPISYLKGSSGGPLLCPAGHAVGLFRAAVCTRGVAKAVYFIPVENLETTMRSPVFTDNSSPPAVTLTHPITKIDTKYIMTCMSADLEVVTSTWVLVGGVLAALAAYCLSTGCVVIVGRIVLSGKPAIIPDREVLYQEFEDVVPCSMGS

SEQ ID NO: 329 - protein, 303 aa, Artificial Sequence
  synthetic polypeptide
DYKDDDDKGSSGTGSGSGTSAPITAYAQQTRGLLGCIITSLTGRDKNQVEGEVQIVSTATQTLLATCINGVCWAVYHGAGTRTIASPKGPVIQMYTNVDKDLVGWPAPQGSRSLTPCTCGSSDLYLVTRHADVIPVRRRGDRRGSLLSPRPISYLKGSSGGPLLCPAGHAVGLFRAAVCTRGVAKAVYFIPVENLETTMRSPVFTDNSSPPAVTLTHPITKIDTKYIMTCMSADLEVVTSTWVLVGGVLAALAAYCLSTGCVVIVGRIVLSGKPAGSSGSSIIPDREVLYQEFEDVVPCSMGS

SEQ ID NO: 330 - protein, 224 aa, Artificial Sequence
  synthetic polypeptide
MSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTEKLYVRDGVLKGDVNMALSLEGGGHYRCDFKTTYKAKKVVQLPDYHFVDHHIEIKSHDKDYSNVNLHEHAEAHSELPRQAK

SEQ ID NO: 331 - protein, 224 aa, Artificial Sequence
  synthetic polypeptide
MSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTENLYVRDGVLKGDVNMALSLEGGGHYRCDFKTTYKAKKVVQLPDYHFVDHHIEIKSHDKDYSNVNLHEHAEAHSELPRQAK

SEQ ID NO: 332 - protein, 224 aa, Artificial Sequence
  synthetic polypeptide
MSVIKPDMKIKLRMEGAVNGHPFAIEGVGLGKPFEGKQSMDLKVKEGGPLPFAYDILTMAFCYGNRVFAKYPENIVDYFKQSFPEGYSWERSMHYEDGGSCNATNDITLDGDCYIYEIRFDGVNFPANGPVMQKRTVKWERSTENLYVRDGVLKSDGNYALSLEGGGHYRCDFKTTYKAKKVVQLPDYHSVDHHIEIKSHDKDYSNVNLHEHAEAHSELPRQAN

SEQ ID NO: 333 - protein, 236 aa, Artificial Sequence
  synthetic polypeptide
MVSKGEENNMAIIKEFMRFKVHMEGSVNGHEFEIEGEGEGRPYEAFQTAKLKVTKGGPLPFAWDILSPQFMYGSKVYIKHPADIPDYFKLSFPEGFRWERVMNFEDGGIIHVNQDSSLQDGVFIYKVKLRGTNFPSDGPVMQKKTMGWEASEERMYPEDGAHKAEIKKRLKLKDGGHYAAEVKTTYKAKKPVQLPGAYIVDIKLDIVSHNEDYTIVEQYERAEGRHSTGGMDELYK

SEQ ID NO: 334 - protein, 595 aa, Artificial Sequence [sequence omitted]

SEQ ID NO: 335 - protein, 314 aa, Artificial Sequence
  synthetic polypeptide
SAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKRMEHLYSMKCKNVVPLYDLLLEMLDAHRLHAPTSRGGASVEETDQSHLATAGSTSSHSLQKYYITGEAEGFPATV

SEQ ID NO: 336 - protein, 314 aa, Artificial Sequence
  synthetic polypeptide
SAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 337 - protein, 314 aa, Artificial Sequence
  synthetic polypeptide
SAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDAALEMLDAHRLHAPTSRGGASVEETDQSHLATAGSTSSHSLQKYYITGEAEGFPATV

SEQ ID NO: 338 - protein, 306 aa, Artificial Sequence
  synthetic polypeptide
PPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLS

SEQ ID NO: 339 - protein, 358 aa, Artificial Sequence
  synthetic polypeptide
PCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLS

SEQ ID NO: 340 - protein, 4 aa, Artificial Sequence
  synthetic polypeptide
PGER

SEQ ID NO: 341 - protein, 5 aa, Artificial Sequence
  synthetic polypeptide
TGSQK

SEQ ID NO: 342 - protein, 5 aa, Artificial Sequence
  synthetic polypeptide
TGEKP

SEQ ID NO: 343 - protein, 4 aa, Artificial Sequence
  synthetic polypeptide
THLR

SEQ ID NO: 344 - protein, 7 aa, Artificial Sequence
  synthetic polypeptide
TGGGEKP

SEQ ID NO: 345 - protein, 55 aa, Artificial Sequence
  synthetic polypeptide
FHYDRNNIAVGADESVVKEAHREVINSSTEGLLLNIDKDIRKILSGYIVEIEDTE

SEQ ID NO: 346 - protein, 7 aa, Artificial Sequence
  synthetic polypeptide
VEIEDTE

SEQ ID NO: 347 - protein, 18 aa, Artificial Sequence
  synthetic polypeptide
KDIRKILSGYIVEIEDTE

SEQ ID NO: 348 - protein, 28 aa, Artificial Sequence
  synthetic polypeptide
STEGLLLNIDKDIRKILSGYIVEIEDTE

SEQ ID NO: 349 - protein, 14 aa, Artificial Sequence
  synthetic polypeptide
EVKQENRLLNESES

SEQ ID NO: 350 - protein, 46 aa, Artificial Sequence
  synthetic polypeptide
VGADESVVKEAHREVINSSTEGLLLNIDKDIRKILSGYIVEIEDTE

SEQ ID NO: 351 - protein, 24 aa, Artificial Sequence
  synthetic polypeptide
GGSGGSGGSGGSGGSGGSGGSGGS

SEQ ID NO: 352 - protein, 40 aa, Artificial Sequence
  synthetic polypeptide
GGGGSGGGGSGGGGSGGGGSGGGGSGGGGSGGGGSGGGGS

SEQ ID NO: 353 - protein, 5 aa, Artificial Sequence
  synthetic polypeptide
GGGGS

SEQ ID NO: 354 - protein, 6 aa, Artificial Sequence
  synthetic polypeptide
GGSGGS

SEQ ID NO: 355 - protein, 16 aa, Artificial Sequence
  synthetic polypeptide
GSGSGSGSGSGSGSGS

SEQ ID NO: 356 - protein, 5 aa, Artificial Sequence
  synthetic polypeptide
TGSKP

SEQ ID NO: 357 - protein, 5 aa, Artificial Sequence
  synthetic polypeptide
TGQKP

SEQ ID NO: 358 - protein, 5 aa, Artificial Sequence
  synthetic polypeptide
TGGKP

SEQ ID NO: 359 - protein, 6 aa, Artificial Sequence
  synthetic polypeptide
TGSQKP

SEQ ID NO: 360 - protein, 21 aa, Artificial Sequence
  synthetic polypeptide
GSGEGRGSLLTCGDVEENPGP

SEQ ID NO: 361 - protein, 23 aa, Artificial Sequence
  synthetic polypeptide
GSGQCTNYALLKLAGDVESNPGP

SEQ ID NO: 362 - protein, 25 aa, Artificial Sequence
  synthetic polypeptide
GSGVKQTLNFDLLKLAGDVESNPGP

SEQ ID NO: 363 - DNA, 494 bp, Artificial Sequence
  synthetic polynucleotide
ccgataaaataaaagattttatttagtctccagaaaaaggggggaatgaaagaccccacctgtaggttatggcaagctagctgcagtaacgccattattgcaaggcatggaaaaataccaaaccaagaatagagaagttcagatcaagggcgggtacatgaaaatagctaacgtagggccaaacaggatatctgcggtgagcagtttcggccccggcccggggccaagaacagatggtcaccgcagtttcggccccggcccgaggccaagagcagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccggg

SEQ ID NO: 364 - DNA, 588 bp, Artificial Sequence
  synthetic polynucleotide
gttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctc

SEQ ID NO: 365 - DNA, 65 bp, Artificial Sequence
  synthetic polynucleotide
taggcgtgtacggtgggaggcctatataagcagagctcgtttagtgaaccgtcagatcgcctgga

SEQ ID NO: 366 - DNA, 63 bp, Artificial Sequence
  synthetic polynucleotide
ttcgcatattaaggtgacgcgtgtggcctcgaacaccgagcgaccctgcagcgacccgcttaa

SEQ ID NO: 367 - DNA, 180 bp, Artificial Sequence
  synthetic polynucleotide
cgccaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgg

SEQ ID NO: 368 - DNA, 592 bp, Artificial Sequence
  synthetic polynucleotide
taatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 369 - DNA, 636 bp, Artificial Sequence
  synthetic polynucleotide
gttggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 370 - DNA, 236 bp, Artificial Sequence
  synthetic polynucleotide
actggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 371 - DNA, 205 bp, Artificial Sequence
  synthetic polynucleotide
tccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtgaaagataccta

SEQ ID NO: 372 - protein, 235 aa, Artificial Sequence
  synthetic polypeptide
VSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWQASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 373 - protein, 544 aa, Artificial Sequence
  synthetic polypeptide
ALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSEQKLISEEDLNGAATTTPAPRPPTPAPTIALQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 374 - protein, 153 aa, Artificial Sequence [sequence omitted]

SEQ ID NO: 375 - protein, 177 aa, Artificial Sequence
  synthetic polypeptide
HSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 376 - protein, 335 aa, Artificial Sequence
  synthetic polypeptide
RKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 377 - protein, 176 aa, Artificial Sequence
  synthetic polypeptide
  misc_feature (19)..(25): Xaa can be any naturally occurring amino acid
  misc_feature (47)..(53): Xaa can be any naturally occurring amino acid
  misc_feature (76)..(82): Xaa can be any naturally occurring amino acid
  misc_feature (104)..(110): Xaa can be any naturally occurring amino acid
  misc_feature (133)..(139): Xaa can be any naturally occurring amino acid
  misc_feature (161)..(167): Xaa can be any naturally occurring amino acid
SRPGERPFQCRICMRNFSXXXXXXXHTRTHTGEKPFQCRICMRNFSXXXXXXXHLRTHTGSQKPFQCRICMRNFSXXXXXXXHTRTHTGEKPFQCRICMRNFSXXXXXXXHLRTHTGSQKPFQCRICMRNFSXXXXXXXHTRTHTGEKPFQCRICMRNFSXXXXXXXHLRTHLRGS

SEQ ID NO: 378 - protein, 606 aa, Artificial Sequence
  synthetic polypeptide
  misc_feature (128)..(134): Xaa can be any naturally occurring amino acid
  misc_feature (156)..(162): Xaa can be any naturally occurring amino acid
  misc_feature (185)..(191): Xaa can be any naturally occurring amino acid
  misc_feature (213)..(219): Xaa can be any naturally occurring amino acid
  misc_feature (242)..(248): Xaa can be any naturally occurring amino acid
  misc_feature (270)..(276): Xaa can be any naturally occurring amino acid
MDAKSLTAWSRTLVTFKDVFVDFTREEWKLLDTAQQILYRNVMLENYKNLVSLGYQLTKPDVILRLEKGEEPWLVEREIHQETHPDSETAFEIKSSVLEGGGGSGGTCRSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 379 - protein, 991 aa, Artificial Sequence
  synthetic polypeptide
  misc_feature (319)..(325): Xaa can be any naturally occurring amino acid
  misc_feature (347)..(353): Xaa can be any naturally occurring amino acid
  misc_feature (376)..(382): Xaa can be any naturally occurring amino acid
  misc_feature (404)..(410): Xaa can be any naturally occurring amino acid
  misc_feature (433)..(439): Xaa can be any naturally occurring amino acid
  misc_feature (461)..(467): Xaa can be any naturally occurring amino acid
MDYKDDDDKGSSGTGSGSGTSAPITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSSPPAVTLTHPITKIDTKYIMTCMSADLEVVTSTWVLVGGVLAALAAYCLSTGCVVIVGRIVLSGKPAIIPDREVLYQEFEDVVPCSMGSPGSRPGERPFQCRICMRNFSXXXXXXXHTRTHTGEKPFQCRICMRNFSXXXXXXXHLRTHTGSQKPFQCRICMRNFSXXXXXXXHLRTHTGEKPFQCRICMRNFSXXXXXXXHLKTHTGSQKPFQCRICMRNFSXXXXXXXHLRTHTGEKPFQCRICMRNFSXXXXXXXHLRTHLRGSTCRDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISSQLCVRGSSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 380 - protein, 172 aa, Artificial Sequence
  synthetic polypeptide
  misc_feature (17)..(23): Xaa can be any naturally occurring amino acid
  misc_feature (45)..(51): Xaa can be any naturally occurring amino acid
  misc_feature (74)..(80): Xaa can be any naturally occurring amino acid
  misc_feature (102)..(108): Xaa can be any naturally occurring amino acid
  misc_feature (131)..(137): Xaa can be any naturally occurring amino acid
  misc_feature (159)..(165): Xaa can be any naturally occurring amino acid
PGERPFQCRICMRNFSXXXXXXXHTRTHTGEKPFQCRICMRNFSXXXXXXXHLRTHTGSQKPFQCRICMRNFSXXXXXXXHTRTHTGEKPFQCRICMRNFSXXXXXXXHLRTHTGSQKPFQCRICMRNFSXXXXXXXHTRTHTGEKPFQCRICMRNFSXXXXXXXHLRTHLR

What is claimed herein is:

1. A synthetic transcription factor (synTF) comprising;
   a. at least one DNA binding domain (DBD), wherein the DBD comprises an engineered zinc-finger binding domain which binds to a DNA-binding motif (DBM),
   b. a transcriptional effector domain (ED),
   c. at least one regulator protein (RP), wherein the RP is a NS3 protease protein, and
      wherein the ED is directly or indirectly coupled or linked to the DBD, and
      wherein the coupling is regulated by the RP.

2. The synTF of claim 1, wherein the transcriptional ED is a transcriptional activator (TA) domain or a transcriptional repressor (TR) domain.

3. The synTF of claim 2, wherein the TA is selected from the group consisting of: p65; Rta; miniVPR; full VPR; VP16; VP64; p300; p300 HAT Core; and a CBP HAT domain, or wherein the TR is selected from the group consisting of: KRAB; KRAB-MeCP2; Hpla; DNMT3B; EED; and HDAC4.

4. The synTF of claim 3, wherein the p65 comprises one of SEQ ID NOs: 69, 117-121, 193-197 or a protein having at least 85% sequence identity one of SEQ ID NOs: 69, 117-121, 193-197.

5. The synTF of claim 3, wherein the KRAB comprises one of SEQ ID NOs: 72, 97, or 214-215, or a protein having at least 85% sequence identity to one of SEQ ID NO: 72, 97, or 214-215.

6. The synTF of claim 1, wherein the ZF-binding domain comprises any one of: 2, 3, 4, 5, 6, 7, 8, 9, 10, 11, 12, 13, 14, 15, 16, 17, 18, or more ZF motifs arranged adjacent to each other in tandem to form a ZF array (ZFA).

7. The synTF of claim 1, wherein the ZF binding domain is selected from any of:
   a. ZF 1-1, ZF 1-2, ZF 1-3, ZF 1-4, ZF 1-5, ZF 1-6, ZF 1-7, ZF 1-8, ZF 2-1, ZF 2-2, ZF 2-3, ZF 2-4, ZF 2-5, ZF 2-6, ZF 2-7, ZF 2-8, ZF 3-1, ZF 3-2, ZF 3-3, ZF 3-4, ZF 3-5, ZF 3-6, ZF 3-7, ZF 3-8, ZF 4-1, ZF 4-2, ZF 4-3, ZF 4-4, ZF 4-5, ZF 4-6, ZF 4-7, ZF 4-8, ZF 5-1, ZF 5-2, ZF 5-3, ZF 5-4, ZF 5-5, ZF 5-6, ZF 5-7, ZF 5-8, ZF 6-1, ZF 6-2, ZF 6-3, ZF 6-4, ZF 6-5, ZF 6-6, ZF 6-7, ZF 6-8, ZF 7-1, ZF 7-2, ZF 7-3, ZF 7-4, ZF 7-5, ZF 7-6, ZF 7-7, ZF 7-8, ZF 8-1, ZF 8-2, ZF 8-3, ZF 8-4, ZF 9-1, ZF 9-2, ZF 9-3, ZF 9-4, ZF 10-1 and ZF 11-1 or a ZF binding domain is selected from any of SEQ ID Nos: 1-3, 76, 101, 377, or 380; or
   b. a ZF binding domain that specifically binds to a sequence comprising at least one of SEQ ID NOs: 181-191.

8. The synTF of claim 1, wherein the at least one DBD is selected from one or more of any of: SEQ ID NO: 221 or 222, 36-4 (SEQ ID NO: 223), 43-8 (SEQ ID NO: 224 or 225), 42-10 (SEQ ID NO: 226 or 227), 97-4 (SEQ ID NO: 228), or wherein the DBD binds to DNA binding motifs (DBM) comprising any of: SEQ ID NOs: 229-240.

9. The synTF of claim 1, wherein the regulator protein comprises the amino acid of SEQ ID NOs: 82, 85, 91, 102, 241-255, 304-315, or a homologue of at least 85% sequence identity to SEQ ID NOs: 82, 85, 91, 102, 241-255, 304-315.

10. The synTF of claim 1, wherein
    a. in the presence of a protease inhibitor, or an inhibitor of NS3 the NS3 protease protein is inhibited, thereby maintaining the coupling of the DBD to the effector domain, or
    b. in the absence of a protease inhibitor or an inhibitor to NS3, the NS3 protease protein is active and result in its excision from the DBD, thereby uncoupling the linkage between the DBD and the effector domain.

11. The synTF of claim 10, wherein an inhibitor of NS3 is selected from any of: grazoprevir (GRZ/GZV), danoprevir, simeprevir, asunaprevir, ciluprevir, boceprevir, sovaprevir, paritaprevir, ombitasvir, paritaprevir, ritonavir, dasabuvir, and telaprevir.

12. The synTF of claim 1, wherein the NS3 protein is part of a Small molecule-Assisted Shutoff (SMASh) domain, wherein the SMASh domain comprises the NS3 protein, a partial protease helical domain and a NS4A domain.

13. The synTF of claim 1, wherein synTF further comprises a Small molecule-Assisted Shutoff (SMASh) tag, wherein the SMASh tag is a N-terminal or C-terminal SMASh domain comprising a repressible protease, a partial protease helical domain and a cofactor domain.

14. The synTF of claim 13, wherein the SMASh tag is selected from:
   a. a C-terminal SMASh domain comprising in a N-terminal to C-terminal order: a NS3 cleavage site, at least one linker, a NS3 domain, a NS3 partial helicase, a NS4A domain, wherein the SMASh tag is fused to the C-terminus of the effector domain of the synTF, or
   b. a N-terminal SMASh domain comprising in a N-terminal to C-terminal order: at least one Linker, a NS3 domain, a NS3 partial helicase, a NS4 domain, and a NS3 cleavage site, wherein the SMASh tag is fused to the N-terminus of the synTF.

15. The synTF of claim 13, wherein in the absence of an inhibitor for the NS3 protease, the NS3 protease is active and self cleaves/uncouples from the synTF, thereby resulting in the SMASh tag targeted for degradation ("SMASh-degradation", synTF-on/TA-on/RP-on), and wherein in the presence of an inhibitor for NS3 protease, NS3 protease activity is inhibited thereby resulting in the SMASh tagged synTF targeted for degradation ("synTF-degradation", synTF-OFF/TA-off/RP-off ').

16. A system for controlling gene expression, comprising:
   a. at least one synthetic transcription factor (synTF) comprising at least one DNA binding domain (DBD), a transcriptional effector domain (ED), and at least one regulator protein (RP),
   wherein the ED is directly or indirectly coupled or linked to the DBD, wherein the coupling is regulated by an RP, and wherein the RP is a NS3 protease protein,
   wherein the RP is regulated by an RP inducer,
   wherein the DBD can bind to a target DNA binding motif (DBM) located upstream of a promoter operatively linked to a gene,
   b. a nucleic acid construct comprising:
      i. at least one target DNA binding motif (DBM) comprising a target nucleic acid for binding of the at least one DBD of the synTF, and
      ii. a promoter sequence located 3' of the at least one DBM, and
      iii. a gene of interest operatively linked to the promoter sequence,
   wherein for synTFs where the coupling of the ED to the DBD is regulated by the at least one RP;
      in the presence of the RP inducer, the coupling of the ED to the DBD of the synTF is maintained, enabling the ED to be in proximity to the promoter sequence when the DBD binds to the DNA binding motif (DBM), where the ED controls the expression of the gene of interest ("ED-on"), or
      in the absence of the RP inducer, the coupling of the ED to the DBD of the synTF is severed, preventing the ED from being in proximity to the promoter sequence when the DBD binds to the DNA binding motif (DBM), preventing gene expression of the gene of interest ("ED-off").

17. The system of claim 16, wherein the transcriptional effector domain (ED) is a transcriptional activator (TA), wherein
   for synTFs where the coupling of the ED to the DBD is regulated by the at least one RP;
      i. in the presence of the RP inducer, the coupling of the ED to the DBD of the synTF is maintained, enabling the TA domain to be in proximity to the promoter sequence when the DBD binds to the DNA binding motif (DBM), where the TA turns on the expression of the gene of interest ("TA-on"), or
      ii. in the absence of the RP inducer, the coupling of the ED to the DBD of the synTF is severed, preventing the TA domain from being in proximity to the promoter sequence when the DBD binds to the DNA binding motif (DBM), preventing expression of the gene of interest ("TA-off").

18. The system of claim 16, wherein the ED is a transcriptional repressor (TR), wherein
   for synTFs where the coupling of the ED to the DBD is regulated by the at least one regulator protein;
      i. in the presence of the RP inducer, the coupling of the ED to the DBD of the synTF is maintained, enabling the transcriptional repressor (TR) to be in proximity to the promoter sequence when the DBD binds to the DNA binding motif (DBM), where the TR prevents expression of the gene of interest ("TR-on" (no-expression), or
      ii. in the absence of the RP inducer, the coupling of the ED to the DBD of the synTF is severed, preventing the transcriptional repressor (TR) from being in proximity to the promoter sequence when the DBD binds to the DNA binding motif (DBM), allowing expression of the gene of interest ("TR-off" (yes-expression).

19. The system of claim 16, wherein the at least one synTF further comprises a N-terminal or C-terminal Small molecule-Assisted Shutoff (SMASh) domain, wherein SMASh domain comprises a self-cleaving SMASh protease, a partial protease helical domain and a cofactor domain,
   wherein in the presence of an inhibitor to the SMASh protease, the SMASh protease activity is inhibited, resulting in the synTF being degraded and preventing the DBD of the synTF binding to the DBM and controlling the expression or repression of the gene of interest ("synTF-degradation"; TA-off (no expression), TR-off (yes-expression)),
   wherein in the absence of an inhibitor to the SMASh protease, the SMASh protease is active and self cleaves/uncouples from the synTF, resulting the SMASh domain being targeted for degradation and allowing the DBD of the synTF to bind to the DBM and the ED of synTF to control the expression of the gene of interest ("SMASh-degradation, TA-on (yes-expression), TR-on (no-expression)).

20. A cell comprising
   a. a first nucleic acid sequence comprising at least one target DNA binding motif (DBM) comprising a target nucleic acid for binding of the at least one DBD of a synTF, a promoter sequence located 3' of the at least one DBM, and a nucleic acid encoding a gene of interest (GOI) operatively linked to the promoter sequence, and
   b. a second nucleic acid sequence comprising a nucleic acid encoding a synthetic transcription factor (synTF) according to claim 1, operatively linked to an inducible or constitutive promoter.

21. The synTF of claim 1, wherein the synTF comprises:
   a. an ED selected from any of: p65; Rta; miniVPR; full VPR; VP16; VP64; p300; p300 HAT Core; and a CBP HAT domain, KRAB; KRAB-MeCP2; Hpla; DNMT3B; EED; and HDAC4; and
   b. a RP selected from any of:
      i. a protease selected from any of: NS3, NS4A, NS3-4, NS4A, NS4B, NS5A HCV.

* * * * *